United States Patent
Lynch et al.

(10) Patent No.: US 8,883,464 B2
(45) Date of Patent: Nov. 11, 2014

(54) METHODS FOR PRODUCING 3-HYDROXYPROPIONIC ACID AND OTHER PRODUCTS

(75) Inventors: Michael D. Lynch, Boulder, CO (US); Ryan T. Gill, Denver, CO (US); Tanya E. W. Lipscomb, Boulder, CO (US)

(73) Assignees: OPX Biotechnologies, Inc., Boulder, CO (US); The Regents of the University of Colorado, a Body Corporate, Denver, CO (US)

( * ) Notice: Subject to any disclaimer, the term of this patent is extended or adjusted under 35 U.S.C. 154(b) by 0 days.

(21) Appl. No.: 13/498,468

(22) PCT Filed: Sep. 27, 2010
(Under 37 CFR 1.47)

(86) PCT No.: PCT/US2010/050436
§ 371 (c)(1),
(2), (4) Date: Feb. 12, 2013

(87) PCT Pub. No.: WO2011/038364
PCT Pub. Date: Mar. 31, 2011

(65) Prior Publication Data
US 2013/0071893 A1 Mar. 21, 2013

Related U.S. Application Data

(60) Provisional application No. 61/246,141, filed on Sep. 27, 2009, provisional application No. 61/298,844, filed on Jan. 27, 2010, provisional application No. 61/321,480, filed on Apr. 6, 2010.

(51) Int. Cl.
| | | |
|---|---|---|
| *C12P 7/40* | (2006.01) | |
| *C12N 9/00* | (2006.01) | |
| *C12N 1/20* | (2006.01) | |
| *C12M 1/00* | (2006.01) | |
| *C12N 15/00* | (2006.01) | |
| *C07H 21/04* | (2006.01) | |
| *C12N 9/02* | (2006.01) | |
| *A61L 15/24* | (2006.01) | |
| *C12P 7/42* | (2006.01) | |
| *C12P 7/52* | (2006.01) | |
| *C12N 15/63* | (2006.01) | |

(52) U.S. Cl.
CPC . *C12N 15/63* (2013.01); *C12P 7/40* (2013.01); *C12N 9/0008* (2013.01); *A61L 15/24* (2013.01); *C12P 7/42* (2013.01); *C12M 47/12* (2013.01); *C12P 7/52* (2013.01)
USPC ..... 435/136; 435/183; 435/252.3; 435/294.1; 435/320.1; 536/23.2

(58) Field of Classification Search
None
See application file for complete search history.

(56) References Cited

U.S. PATENT DOCUMENTS

| | | |
|---|---|---|
| 2,408,889 A | 10/1946 | Short |
| 2,464,768 A | 3/1949 | Redmon et al. |
| 2,469,701 A | 5/1949 | Redmon |
| 2,798,053 A | 7/1957 | Brown et al. |
| 3,904,685 A | 9/1975 | Shahidi et al. |
| 3,915,921 A | 10/1975 | Schlatzer, Jr. |
| 4,029,577 A | 6/1977 | Godlewski et al. |
| 4,268,641 A | 5/1981 | Koenig et al. |
| 4,301,266 A | 11/1981 | Muenster et al. |
| 4,431,547 A | 2/1984 | Dubin |
| 4,666,983 A | 5/1987 | Tsubakimoto et al. |
| 4,685,915 A | 8/1987 | Hasse et al. |
| 4,708,997 A | 11/1987 | Stanley, Jr. et al. |
| 4,734,478 A | 3/1988 | Tsubakimoto et al. |
| 4,857,610 A | 8/1989 | Chmelir et al. |
| 4,952,505 A | 8/1990 | Cho |
| 4,985,518 A | 1/1991 | Alexander et al. |
| 5,009,653 A | 4/1991 | Osborn, III |
| 5,093,472 A | 3/1992 | Bresciani |
| 5,135,677 A | 8/1992 | Yamaguchi et al. |
| 5,145,906 A | 9/1992 | Chambers et al. |
| 5,180,798 A | 1/1993 | Nakamura et al. |
| 5,252,474 A | 10/1993 | Gewain et al. |
| 5,331,059 A | 7/1994 | Engelhardt et al. |
| 5,342,899 A | 8/1994 | Graham et al. |
| 5,350,799 A | 9/1994 | Woodrum et al. |
| 5,426,199 A | 6/1995 | Lundquist |
| 5,470,928 A | 11/1995 | Harwood et al. |
| 5,510,307 A | 4/1996 | Narayanan et al. |
| 5,510,526 A | 4/1996 | Baniel et al. |
| 5,558,656 A | 9/1996 | Bergman |
| 5,723,639 A | 3/1998 | Datta et al. |

(Continued)

FOREIGN PATENT DOCUMENTS

| | | |
|---|---|---|
| EP | 1124789 B1 | 9/2004 |
| EP | 1036190 B1 | 5/2005 |

(Continued)

OTHER PUBLICATIONS

Chica et al. Curr Opin Biotechnol. Aug. 2005;16(4):378-84.*
Sen et al. Appl Biochem Biotechnol. Dec. 2007;143(3):212-23.*
Asano, et al. A new enzymatic method of acrylamide production. Agricultural and Biological Chemistry. 1982; 46(5):1183-1190.
Brown, et al. Synthesis of labeled acrylamide and N-methylolacrylamide (NMA): 15N-acrylamide, 13C-NMA, 15N-NMA, and 13C,15N-NMA. Journal of labelled compounds & radiopharmaceuticals. 2005; 48(14):1031-1039.
Kurcok, et al. Reactions of β-lactones with potassium alkoxides and their complexes with 18-crown-6 in aprotic solvents. Journal of Organic Chemistry. 1993; 58(16):4219-4220.
Langlois, et al. A new preparation of trifluoromethanesulfinate salts. Journal of Fluorine Chemistry. 2007; 128(7):851-856.

(Continued)

*Primary Examiner* — Christian Fronda
(74) *Attorney, Agent, or Firm* — Wilson Sonsini Goodrich & Rosati

(57) ABSTRACT

This invention relates to metabolically engineered microorganism strains, such as bacterial strains, in which there is an increased utilization of malonyl-CoA for production of a chemical product, which includes 3-hydroxypropionic acid.

31 Claims, 65 Drawing Sheets

(56) References Cited

U.S. PATENT DOCUMENTS

| | | | |
|---|---|---|---|
| 5,817,870 A | 10/1998 | Haas et al. |
| 5,827,255 A | 10/1998 | Crainic |
| 5,876,983 A | 3/1999 | Sugimoto et al. |
| 6,004,773 A | 12/1999 | Araki et al. |
| 6,013,494 A | 1/2000 | Nakamura et al. |
| 6,087,140 A | 7/2000 | Cameron et al. |
| 6,284,495 B1 | 9/2001 | Sato et al. |
| 6,297,319 B1 | 10/2001 | Nagasuna et al. |
| 6,472,188 B1 | 10/2002 | Lee et al. |
| 6,534,679 B2 | 3/2003 | Eyal et al. |
| 6,623,944 B2 | 9/2003 | Rieping |
| 6,709,919 B2 | 3/2004 | Tu |
| 6,723,799 B2 | 4/2004 | Sun et al. |
| 6,852,517 B1 | 2/2005 | Suthers et al. |
| 6,960,455 B2 | 11/2005 | Livshits et al. |
| 7,090,998 B2 | 8/2006 | Ishikawa et al. |
| 7,141,154 B2 | 11/2006 | Lin et al. |
| 7,153,663 B2 | 12/2006 | Payne et al. |
| 7,166,743 B2 | 1/2007 | Zhong et al. |
| 7,186,541 B2 | 3/2007 | Gokarn et al. |
| 7,186,856 B2 | 3/2007 | Meng et al. |
| 7,223,567 B2 | 5/2007 | Ka-Yiu et al. |
| 7,279,598 B2 | 10/2007 | Meng et al. |
| 7,285,406 B2 | 10/2007 | Payne et al. |
| 7,309,597 B2 | 12/2007 | Liao et al. |
| 7,326,557 B2 | 2/2008 | San et al. |
| 7,358,071 B2 | 4/2008 | Payne et al. |
| 7,393,676 B2 | 7/2008 | Gokarn et al. |
| 7,524,660 B2 | 4/2009 | Caimi et al. |
| 7,538,247 B2 | 5/2009 | Craciun et al. |
| 7,638,316 B2 | 12/2009 | Gokarn et al. |
| 7,678,869 B2 | 3/2010 | Matyjaszewski et al. |
| 7,687,661 B2 | 3/2010 | Lilga et al. |
| 7,826,975 B2 | 11/2010 | Maranas et al. |
| 7,833,761 B2 | 11/2010 | Terashita et al. |
| 7,943,362 B2 | 5/2011 | Frost |
| 8,048,624 B1 | 11/2011 | Lynch |
| 8,076,111 B2 | 12/2011 | Fukui et al. |
| 8,652,816 B2 | 2/2014 | Lynch |
| 2002/0164729 A1 | 11/2002 | Skraly et al. |
| 2003/0101486 A1 | 5/2003 | Facciotti et al. |
| 2003/0191146 A1 | 10/2003 | Kabbash et al. |
| 2003/0211131 A1 | 11/2003 | Martin et al. |
| 2003/0233675 A1 | 12/2003 | Cao et al. |
| 2003/0235892 A1 | 12/2003 | Katz et al. |
| 2004/0009466 A1 | 1/2004 | Maranas et al. |
| 2004/0076982 A1 | 4/2004 | Gokarn et al. |
| 2004/0152159 A1 | 8/2004 | Causey et al. |
| 2004/0152174 A1 | 8/2004 | Cervin et al. |
| 2004/0209337 A1 | 10/2004 | Frost et al. |
| 2004/0210087 A1 | 10/2004 | Meng et al. |
| 2004/0214294 A1 | 10/2004 | Rieping |
| 2005/0054060 A1 | 3/2005 | Chateau et al. |
| 2005/0196758 A1 | 9/2005 | Rock et al. |
| 2005/0221466 A1 | 10/2005 | Liao et al. |
| 2005/0222458 A1 | 10/2005 | Craciun et al. |
| 2005/0233031 A1 | 10/2005 | Hughes |
| 2005/0239179 A1 | 10/2005 | Skraly et al. |
| 2005/0283029 A1 | 12/2005 | Meng et al. |
| 2006/0014977 A1 | 1/2006 | Miller et al. |
| 2006/0084098 A1 | 4/2006 | Gill et al. |
| 2007/0010708 A1 | 1/2007 | Ness |
| 2007/0087403 A1 | 4/2007 | Bestel-Corre et al. |
| 2007/0107080 A1 | 5/2007 | Liao et al. |
| 2007/0148749 A1 | 6/2007 | Yasuda et al. |
| 2007/0184524 A1 | 8/2007 | Gokarn et al. |
| 2007/0219390 A1 | 9/2007 | Zacher et al. |
| 2007/0245431 A1 | 10/2007 | Metz et al. |
| 2008/0076167 A1 | 3/2008 | Gokarn et al. |
| 2008/0124785 A1 | 5/2008 | Liao et al. |
| 2008/0193989 A1 | 8/2008 | Verser et al. |
| 2008/0199926 A1 | 8/2008 | Burgard et al. |
| 2009/0017514 A1 | 1/2009 | Datta et al. |
| 2009/0023006 A1 | 1/2009 | Bub et al. |
| 2009/0031453 A1 | 1/2009 | Jessen et al. |
| 2009/0053783 A1 | 2/2009 | Gokarn et al. |
| 2009/0076297 A1 | 3/2009 | Bogan, Jr. et al. |
| 2009/0082286 A1 | 3/2009 | Huang et al. |
| 2009/0111151 A1 | 4/2009 | Julien et al. |
| 2009/0203097 A1 | 8/2009 | Flint et al. |
| 2009/0234146 A1 | 9/2009 | Cooney et al. |
| 2009/0291480 A1 | 11/2009 | Jessen et al. |
| 2009/0298144 A1 | 12/2009 | Tsobanakis et al. |
| 2009/0305369 A1 | 12/2009 | Donaldson et al. |
| 2009/0325248 A1 | 12/2009 | Marx et al. |
| 2010/0021978 A1 | 1/2010 | Burk et al. |
| 2010/0151536 A1 | 6/2010 | Baynes et al. |
| 2010/0210017 A1 | 8/2010 | Gill et al. |
| 2011/0125118 A1 | 5/2011 | Lynch |
| 2011/0144377 A1 | 6/2011 | Eliot et al. |
| 2011/0183391 A1 | 7/2011 | Frost |
| 2011/0244575 A1 | 10/2011 | Lipscomb et al. |
| 2011/0275851 A1 | 11/2011 | Orjuela et al. |
| 2012/0041232 A1 | 2/2012 | Lynch |
| 2012/0244586 A1 | 9/2012 | Gokarn et al. |
| 2014/0045231 A1 | 2/2014 | Lynch |
| 2014/0135526 A1 | 5/2014 | Lynch |

FOREIGN PATENT DOCUMENTS

| | | |
|---|---|---|
| EP | 1305439 B1 | 6/2006 |
| EP | 1124979 B1 | 8/2006 |
| EP | 1731604 A1 | 12/2006 |
| EP | 1105514 B1 | 2/2008 |
| EP | 1778840 B1 | 6/2008 |
| EP | 1975236 A2 | 10/2008 |
| EP | 1654212 B1 | 7/2009 |
| EP | 1975236 A3 | 9/2009 |
| EP | 1706457 B1 | 2/2012 |
| GB | 2473755 B | 9/2011 |
| JP | H 09-505463 | 6/1997 |
| WO | WO 2007/042494 A2 | 4/1997 |
| WO | WO 98/21339 A1 | 5/1998 |
| WO | WO 98/55442 A1 | 12/1998 |
| WO | WO 00/56693 A1 | 9/2000 |
| WO | WO 01/16346 A1 | 3/2001 |
| WO | WO 01/38284 A1 | 5/2001 |
| WO | WO 02/34784 A2 | 5/2002 |
| WO | WO 02/42418 A2 | 5/2002 |
| WO | WO 02/090312 A1 | 11/2002 |
| WO | WO 03/040690 A2 | 5/2003 |
| WO | WO 02/042418 A3 | 6/2003 |
| WO | WO 03/062173 A2 | 7/2003 |
| WO | WO 03/082795 A2 | 10/2003 |
| WO | WO 2004/018621 A2 | 3/2004 |
| WO | WO 2004/033646 A2 | 4/2004 |
| WO | WO 2004/018621 A3 | 9/2004 |
| WO | WO 03/040690 A3 | 10/2004 |
| WO | WO 2005/003074 A1 | 1/2005 |
| WO | WO 2005/047498 A1 | 5/2005 |
| WO | WO 03/062173 A3 | 11/2005 |
| WO | WO 2005/105770 A2 | 11/2005 |
| WO | WO 2005/118719 A2 | 12/2005 |
| WO | WO 2005/105770 A3 | 3/2006 |
| WO | WO 2004/033646 A3 | 5/2006 |
| WO | WO 2005/118719 A3 | 9/2006 |
| WO | WO 2006/121755 A2 | 11/2006 |
| WO | WO 2007/012078 A1 | 1/2007 |
| WO | WO 2007/030830 A2 | 3/2007 |
| WO | WO 2007/047680 A2 | 4/2007 |
| WO | WO 2006/121755 A3 | 6/2007 |
| WO | WO 2007/030830 A3 | 10/2007 |
| WO | WO 2007/042494 A3 | 11/2007 |
| WO | WO 2007/047680 A3 | 11/2007 |
| WO | WO 2008/023039 A1 | 2/2008 |
| WO | WO 2008/027742 A1 | 3/2008 |
| WO | WO 2008/028002 A1 | 3/2008 |
| WO | WO 2008/089102 A2 | 7/2008 |
| WO | WO 2008/091627 A2 | 7/2008 |
| WO | WO 2008/145737 A1 | 12/2008 |
| WO | WO 2008/089102 A3 | 1/2009 |
| WO | WO 2009/031737 A1 | 3/2009 |
| WO | WO 2008/091627 A3 | 5/2009 |
| WO | WO 2009/062190 A2 | 5/2009 |

(56) References Cited

FOREIGN PATENT DOCUMENTS

| WO | WO 2009/089457 A1 | 7/2009 |
| WO | WO 2009/094485 A1 | 7/2009 |
| WO | WO 2009/062190 A3 | 9/2009 |
| WO | WO 2009/111513 A1 | 9/2009 |
| WO | WO 2010/011874 A2 | 1/2010 |
| WO | WO 2010/031083 A2 | 3/2010 |
| WO | WO 2011/038364 A1 | 3/2011 |
| WO | WO 2011/063304 A1 | 5/2011 |
| WO | WO 2011/063363 A2 | 5/2011 |
| WO | WO 2011/063363 A3 | 8/2011 |
| WO | WO 2011/094457 A1 | 8/2011 |
| WO | WO 2012/054400 A1 | 4/2012 |

OTHER PUBLICATIONS

Liang, et al. Fe2(SO4)3.4H2O/concentrated H2SO4: an efficient catalyst for esterification. Journal of Chemical Research, Synopses. 2004; 3:226-227.

Orjuela, et al. Presentation: Recovery of succinic acid from fermentative broth through esterification with ethanol. Department of Chemical Engineering and Materials Science. Michigan State University. East Lansing, Michigan 48824. Jun. 29, 2010.

Ramalinga, et al. A mild and efficient method for esterification and transesterification catalyzed by iodine. Tetrahedron Letters. 2002; 43(5):879-882.

Ren, et al. Molecular Iodine in Ionic Liquid: A Green Catalytic System for Esterification and Transesterification. Synthetic Communications. 2010; 40(11):1670-1676.

Rodriguez, et al. Structure-cytoprotective activity relationship of simple molecules containing an alpha,beta-unsaturated carbonyl system. J Med Chem. Jun. 6, 1997;40(12):1827-34.

Sun, et al. ZrOCl2 x 8H2O: an efficient, cheap and reusable catalyst for the esterification of acrylic acid and other carboxylic acids with equimolar amounts of alcohols. Molecules. Apr. 10, 2006;11(4):263-71.

U.S. Appl. No. 13/527,799, filed Jun. 20, 2012, Tengler et al.

Dell'Aquila, et al. Acid-base balance in peritoneal dialysis. J Nephrol. Mar.-Apr. 2006;19 Suppl 9:S104-7.

Duncan, et al. Lactate-utilizing bacteria, isolated from human feces, that produce butyrate as a major fermentation product. Appl Environ Microbiol. Oct. 2004;70(10):5810-7.

Kozliak, et al. Expression of proteins encoded by the *Escherichia coli* cyn operon: carbon dioxide-enhanced degradation of carbonic anhydrase. J Bacteriol. Sep. 1994;176(18):5711-7.

Kozliak, et al. Role of bicarbonate/CO2 in the inhibition of *Escherichia coli* growth by cyanate. J Bacteriol. Jun. 1995;177(11):3213-9.

Meng, et al. Nucleotide sequence of the *Escherichia coli* cad operon: a system for neutralization of low extracellular pH. J Bacteriol. Apr. 1992;174(8):2659-69.

Moreau. The lysine decarboxylase CadA protects *Escherichia coli* starved of phosphate against fermentation acids. J Bacteriol. Mar. 2007;189(6):2249-61. Epub Jan. 5, 2007.

Stim, et al. Nucleotide sequence of the adi gene, which encodes the biodegradative acid-induced arginine decarboxylase of *Escherichia coli*. J Bacteriol. Mar. 1993;175(5):1221-34.

Turlin, et al. 3-phenylpropionate catabolism and the *Escherichia coli* oxidative stress response. Res Microbiol. Apr. 2005;156(3):312-21. Epub Jan. 27, 2005.

Warnecke, et al. Identification of a 21 amino acid peptide conferring 3-hydroxypropionic acid stress-tolerance to *Escherichia coli*. Biotechnol Bioeng. May 2012;109(5):1347-52. doi: 10.1002/bit.24398. Epub Jan. 2, 2012.

Anton, et al. Sequencing and overexpression of the *Escherichia coli* aroE gene encoding shikimate dehydrogenase. Biochem J. Jan. 15, 1988;249(2):319-26.

Dewick, P. Chapter 4. The Shikimate Pathway: Aromatic Amino Acids and Phenylpropanoids. Medicinal Natural Products: A Biosynthetic Approach, Second Edition (2002): 121-166.

Duncan, et al. The overexpression and complete amino acid sequence of *Escherichia coli* 3-dehydroquinase. Biochem J. Sep. 1, 1986;238(2):475-83.

Ginkel, et al. Identification and cloning of the Mycobacterium avium folA gene, required for dihydrofolate reductase activity. FEMS Microbiol Lett. Nov. 1, 1997;156(1):69-78.

Gray, et al. Monofunctional chorismate mutase from Bacillus subtilis: purification of the protein, molecular cloning of the gene, and overexpression of the gene product in *Escherichia coli*. Biochemistry. Jan. 16, 1990;29(2):376-83.

Jiang, et al. Cloning and Expression of aroG Gene of *E. coli* and Its Co-expression with pheA and tyrB Genes. Sheng Wu Hua Xue Yu Sheng Wu Wu Li Xue Bao (Shanghai). 1998;30(6):593-596. (In Chinese with English abstract).

Oliviera, et al. Cloning and overexpression in soluble form of functional shikimate kinase and 5-enolpyruvylshikimate 3-phosphate synthase enzymes from Mycobacterium tuberculosis. Protein Expr Purif. Aug. 2001;22(3):430-5.

White, et al. The overexpression, purification and complete amino acid sequence of chorismate synthase from *Escherichia coli* K12 and its comparison with the enzyme from Neurospora crassa. Biochem J. Apr. 15, 1988;251(2):313-22.

U.S. Appl. No. 13/575,581, filed Jul. 26, 2012, Lynch et al.

Broun, et al. Catalytic plasticity of fatty acid modification enzymes underlying chemical diversity of plant lipids. Science. Nov. 13, 1998;282(5392):1315-7.

Chica, et al. Semi-rational approaches to engineering enzyme activity: combining the benefits of directed evolution and rational design. Curr Opin Biotechnol. Aug. 2005;16(4):378-84.

Cho, et al. Simultaneous synthesis of enantiomerically pure (S)-amino acids and (R)-amines using coupled transaminase reactions. Biotechnol Bioeng. Mar. 30, 2003;81(7):783-9.

Devos, et al. Practical limits of function prediction. Proteins. Oct. 1, 2000;41(1):98-107.

Ivanova, et al. Genome sequence of *Bacillus cereus* and comparative analysis with *Bacillus anthracis*. Nature. May 1, 2003;423(6935):87-91.

Kimchi-Sarfaty, et al. A "silent" polymorphism in the MDR1 gene changes substrate specificity. Science. Jan. 26, 2007;315(5811):525-8. Epub Dec. 21, 2006.

Kisselev. Polypeptide release factors in prokaryotes and eukaryotes: same function, different structure. Structure. Jan. 2002;10(1):8-9.

Nackley, et al. Human catechol-O-methyltransferase haplotypes modulate protein expression by altering mRNA secondary structure. Science. Dec. 22, 2006;314(5807):1930-3.

Office action dated Jul. 11, 2012 for U.S. Appl. No. 13/055,138.

Office action dated Aug. 29, 2012 for Chinese Application No. 200980137400.4 (in Chinese with English translation).

Office action dated Sep. 18, 2012 for U.S. Appl. No. 12/891,790.

Office action dated Sep. 19, 2012 for JP Application No. 2012-531103 (in Japanese with English translation).

Sauna, et al. Silent polymorphisms speak: how they affect pharmacogenomics and the treatment of cancer. Cancer Res. Oct. 15, 2007;67(20):9609-12.

Seffernick, et al. Melamine deaminase and atrazine chlorohydrolase: 98 percent identical but functionally different. J Bacteriol. Apr. 2001;183(8):2405-10.

Sen, et al. Developments in directed evolution for improving enzyme functions. Appl Biochem Biotechnol. Dec. 2007;143(3):212-23.

Sousa, et al. The ARO4 gene of *Candida albicans* encodes a tyrosine-sensitive DAHP synthase: evolution, functional conservation and phenotype of Aro3p-, Aro4p-deficient mutants. Microbiology. May 2002;148(Pt 5):1291-303.

Takamura, et al. Changes in the intracellular concentration of acetyl-CoA and malonyl-CoA in relation to the carbon and energy metabolism of *Escherichia coli* K12. J Gen Microbiol. Aug. 1988;134(8):2249-53.

Third party submission under 37 C.F.R Section 1.290 dated Sep. 17, 2012 against U.S. Appl. No. 13/284,337.

Whisstock, et al. Prediction of protein function from protein sequence and structure. Q Rev Biophys. Aug. 2003;36(3):307-40.

(56) References Cited

OTHER PUBLICATIONS

Wishart, et al. A single mutation converts a novel phosphotyrosine binding domain into a dual-specificity phosphatase. J Biol Chem. Nov. 10, 1995;270(45):26782-5.
Witkowski, et al. Conversion of a beta-ketoacyl synthase to a malonyl decarboxylase by replacement of the active-site cysteine with glutamine. Biochemistry. Sep. 7, 1999;38(36):11643-50.
European search report dated Jan. 3, 2013 for Application No. 09813810.0.
Office action dated Feb. 13, 2013 for U.S. Appl. No. 12/523,047.
Office action dated Feb. 20, 2013 for U.S. Appl. No. 12/891,760.
Ray, et al. Mutational analysis of the catalytic and feedback sites of the tryptophan-sensitive 3-deoxy-D-arabino-heptulosonate-7-phosphate synthase of *Escherichia coli*. J Bacteriol. Dec. 1988;170(12):5500-6.
Cronk, et al. Cloning, crystallization and preliminary characterization of a beta-carbonic anhydrase from *Escherichia coli*. Acta Crystallogr D Biol Crystallogr. Sep. 2000;56(Pt 9):1176-9.
Diaz, et al. Characterization of the hca cluster encoding the dioxygenolytic pathway for initial catabolism of 3-phenylpropionic acid in *Escherichia coli* K-12. J Bacteriol. Jun. 1998;180(11):2915-23.
Fernando, et al. Biorefineries: current status, challenges and future direction Energ. Fuel. 2006; 20:1727-1737.
Figge, et al. Methionine biosynthesis is *Escherichia coli* and *Corynebacterium glutamicum*. Microbiol Monogro. 2007; 5:163-193.
Muday, et al. The tyrosine repressor negatively regulates aroH expression in *Escherichia coli*. Bacteriol. Jun. 1991;173(12):3930-2.
Office action dated Nov. 2, 2012 for U.S. Appl. No. 13/416,103.
Office action dated Nov. 27, 2012 for U.S. Appl. No. 13/284,337.
Price-Carter, et al. Polyphosphate kinase protects *Salmonella enterica* from weak organic acid stress. Journal of Bacteriology. 2005; 187:3088-3099.
Warnecke, et al. Engineering of Organic Acid Tolerance Genes in *E. coli* for Biorefinery Applications. 2006 AIChE Annual meeting in San Francisco, California, Nov. 12-17, 2006, https://aiche.confex.comlaiche/2006/techprogram/P67122.HTM.
U.S. Appl. No. 12/891,760, filed Sep. 27, 2010, Lynch.
U.S. Appl. No. 12/891,790, filed Sep. 27, 2010, Lynch.
U.S. Appl. No. 13/062,917, filed Mar. 8, 2011, Lynch.
U.S. Appl. No. 13/416,103, filed Mar. 9, 2012, Lipscomb et al.
Agriculture Project Fact Sheet. U.S. Department of Energy, Office of Industrial Technologies. 2001. Chemicals From Lignocellulose, http://www.oit.doe.gov/agriculture/factsheets/lignocellulose.pdf (Apr. 21, 2004).
Alber, et al. Malonyl-coenzyme A reductase in the modified 3-hydroxypropionate cycle for autotrophic carbon fixation in archaeal *Metallosphaera* and *Sulfolobus* spp. J Bacteriol. Dec. 2006;188(24):8551-9.
Bailey, et al. Inverse metabolic engineering: A strategy for directed genetic engineering of useful phenotypes. BBiotechnol Bioeng. Sep. 5, 2002;79(5):568-79.
Bailey. Toward a science of metabolic engineering. Science. Jun. 21, 1991;252(5013):1668-75.
Barbin, et al. Induction of specific base-pair substitutions in *E. coli* trpA mutants by chloroethylene oxide, a carcinogenic vinyl chloride metabolite. Mutat Res. Nov.-Dec. 1985;152(2-3):147-56.
Bastian, et al. Engineered ketol-acid reductoisomerase and alcohol dehydrogenase enable anaerobic 2-methylpropan-l-ol production at theoretical yield in *Escherichia coli*. Metab Eng. May 2011;13(3):345-52.
Beguin et al. The biological degradation of cellulose. FEMS Microbiol Rev. Jan. 1994;13(1):25-58.
Bergler et al. Sequences of the envM gene and of two mutated alleles in *Escherichia coli*. J Gen Microbiol. Oct. 1992;138(10):2093-100.
Brock, et al. Naturally occurring adenines within mRNA coding sequences affect ribosome binding and expression in *Escherichia coli*. J Bacteriol. Jan. 2007;189(2):501-10. Epub Nov. 3, 2006.

Bunch, et al. The ldhA gene encoding the fermentative lactate dehydrogenase of *Escherichia coli*. Microbiology. Jan. 1997;143 ( Pt 1):187-95.
Canada, et al. Directed evolution of toluene ortho-monooxygenase for enhanced 1-naphthol synthesis and chlorinated ethene degradation. J Bacteriol. Jan. 2002;184(2):344-9.
Chang, et al. Acetate metabolism in a pta mutant of *Escherichia coli* W3110: importance of maintaining acetyl coenzyme A flux for growth and survival. J Bacteriol. Nov. 1999;181(21):6656-63.
Chotani, et al. The commercial production of chemicals using pathway engineering. Biochim Biophys Acta. Dec. 29, 2000;1543(2):434-455.
Cleusix, et al. Inhibitory activity spectrum of reuterin produced by *Lactobacillus reuteri* against intestinal bacteria. BMC Microbiol. Nov. 12, 2007;7:101.
Cowan, et al. Characterization of the major promoter for the plasmid-encoded sucrose genes scrY, scrA, and scrB. J Bacteriol. Dec. 1991;173(23):7464-70.
Crameri, et al. DNA shuffling of a family of genes from diverse species accelerates directed evolution . Nature. Jan. 15, 1998;391(6664):288-91.
Cronan, et al. Genetic and biochemical analyses of pantothenate biosynthesis in *Escherichia coli* and *Salmonella typhimurium*.J Bacteriol. Mar. 1982;149(3):916-22.
Cronan, J.E., Beta-Alanine Synthesis in *Escherichia coli* J Bacteriol. Mar. 1980;141(3):1291-7.
De Mendoza, et al Thermal regulation of membrane lipid fluidity in bacteria. Trends Biochem. Sci. 1983; 8:49-52.
Den, et al. Enzymatic Conversion of β-Hydroxypropionate to Malonic Semialdehyde. J Biol Chem Jul. 1959;234(7):1666-1671.
Dohr, et al. Engineering of a functional human NADH-dependent cytochrome P450 system. Proc Natl Acad Sci U S A. Jan. 2, 2001;98(1):81-6.
Drake, et al. Structure of the EntB multidomain nonribosomal peptide synthetase and functional analysis of its interaction with the EntE adenylation domain. Chem Biol. Apr. 2006;13(4):409-19.
Energetics Incorporated. 2003. Industrial Bioproducts: Today and Tomorrow. U.S. Department of Energy, Office of Energy Efficiency and Renewable Energy, Office of the Biomass Program, Washington, D.C.
Eppink, et al. Switch of coenzyme specificity of p-hydroxybenzoate hydroxylase. J Mol Biol. Sep. 10, 1999;292(1):87-96.
Epstein, et al. Oil: A Life Cycle Analysis of its Health and Environmental Impacts. The Center for Health and the Global Environment, Harvard Medical School. Mar. 2002. www.med.harvard.edu/chge/oil.html.
European search report dated Jul. 2, 2010 for Application No. 08727619.2.
Farmer, et al. Improving lycopene production in *Escherichia coli* by engineering metabolic control. Nat Biotechnol. May 2000;18(5):533-7.
Fodor, et al. Light-Directed, Spatially Addressable Parallel Chemical Synthesis. Science. Feb. 15, 1991;251(4995):767-73.
Funa, et al. A novel quinone-forming monooxygenase family involved in modification of aromatic polyketides. J Biol Chem. Apr. 15, 2005;280(15):14514-23. Epub Feb. 8, 2005.
GenBank Accession No. X81461 AF473544 (Sep. 7, 1994).
GenBank Accession No. AAS20429.1 (Jan. 19, 2004).
Gill, et al. Genome-wide screening for trait conferring genes using DNA microarrays. Proc Natl Acad Sci U S A. May 14, 2002;99(10):7033-8. Epub May 7, 2002.
Gokarn, et al. Metabolic analysis of *Escherichia coli* in the presence and absence of the carboxylating enzymes phosphoenolpyruvate carboxylase and pyruvate carboxylase. Appl Environ Microbiol. May 2000;66(5):1844-50.
Goodwin, et al. Purification and characterization of methylmalonate-semialdehyde dehydrogenase from rat liver. Identity to malonate-semialdehyde dehydrogenase. J Biol Chem. Sep. 5, 1989;264(25):14965-71.
Gronenborn. Overproduction of phage lambda repressor under control of the lac promotor of *Escherichia coli*. Mol Gen Genet. Nov. 17, 1976;148(3):243-50.

(56) References Cited

OTHER PUBLICATIONS

Gulmezian, et al. Genetic evidence for an interaction of the UbiG O-methyltransferase with UbiX in *Escherichia coli* coenzyme Q biosynthesis. J Bacteriol. Sep. 2006;188(17):6435-9.

Hall, et al. Structure-function analysis of NADPH:nitrate reductase from *Aspergillus nidulans*: analysis of altered pyridine nucleotide specificity in vivo. Microbiology. Jun. 2000;146 ( Pt 6):1399-406.

Hatzimanikatis, et al. Exploring the diversity of complex metabolic networks. Bioinformatics. Apr. 15, 2005;21(8):1603-9. Epub Dec. 21, 2004.

He, et al. A T42M substitution in bacterial 5-enolpyruvylshikimate-3-phosphate synthase (EPSPS) generates enzymes with increased resistance to glyphosate. Biosci Biotechnol Biochem. Jun. 2003;67(6):1405-9.

Heath, et al. Enoyl-acyl carrier protein reductase (fabI) plays a determinant role in completing cycles of fatty acid elongation in *Escherichia coli*. J Biol Chem. Nov. 3, 1995;270(44):26538-42.

Henry, et al. Discovery of novel routes for the biosynthesis of industrial chemicals: 3-Hydroxypropanoate. Slides. AICHE Annual Meeting. Nov. 8, 2007. Salt Lake City, UT.

Herter, et al. Autotrophic $CO_2$ Fixation by *Chloroflexus aurantiacus*: Study of Glyoxylate Formation and Assimilation via the 3-Hydroxypropionate Cycle. J Bacteriol Jul. 2001;183(14):4305-4316.

Hondorp et al. Oxidation of cysteine 645 of cobalamin-independent methionine synthase causes a methionine limitation in *Escherichia coli*. J Bacteriol. May 2009;191(10):3407-10. Epub Mar. 13, 2009.

Hügler, et al. Malonyl-Coenzyme A Reductase from *Chloroflexus aurantiacus*, a Key Enzyme of the 3-Hydroxypropionate Cycle for Autotrophic $CO_2$ Fixation. J Bacteriol May 2002;184(9):2404-2410.

International search report and written report dated Jun. 3, 2011 for PCT Application No. US2010/057690.

International search report dated Feb. 3, 2011 for PCT Application No. US2010/050436.

International search report dated Jun. 4, 2010 for PCT Application No. US2009/51607.

International search report dated Jun. 16, 2011 for PCT Application No. US2011/022790.

International search report dated Dec. 5, 2008 for PCT Application No. US08/50921.

International search report dated Apr. 29, 2010 for PCT Application No. US2009/57058.

Jiang, et al. Biosynthetic pathways for 3-hydroxypropionic acid production. Appl Microbiol Biotechnol. Apr. 2009;82(6):995-1003.

Joike, et al Amino acid substitutions affecting catalytic activity and subunit interactions of aminodeoxychorismate synthase in *E. coli*. Abstracts of the General Meeting of the American Society for Microbiology. 2002; 102:275-276, and 102nd General Meeting of the American Society for Microbiology; Salt Lake, UT, USA; May 19-23, 2002.

Kapol, et al. Purification and characterization of 2-oxoglutarate decarboxylase of Leuconostoc oenos. Journal of General Microbiology 136 (1990), 1497-1499.

Kern, et al. Engineering primary metabolic pathways of industrial micro-organisms. J Biotechnol. Mar. 30, 2007;129(1):6-29. Epub Dec. 2, 2006.

Kim et al. Extractive Recovery of Products from Fermentation Broths. Biotechnol. Bioprocess Eng., 1999; 4:1-11.

Kim, et al. The Rut pathway for pyrimidine degradation: novel chemistry and toxicity problems. J Bacteriol. Aug. 2010;192(16):4089-102. Epub Ap. 16, 2010.

Kim, et al. Dihydrolipoamide dehydrogenase mutation alters the NADH sensitivity of pyruvate dehydrogenase complex of *Escherichia coli* K-12. J Bacteriol. Jun. 2008;190(11):3851-8. Epub Mar. 28, 2008.

Kim, et al. Effect of overexpression of *Actinobacillus succinogenes* phosphoenolpyruvate carboxykinase on succinate production in *Escherichia coli*. Appl Environ Microbiol. Feb. 2004;70(2):1238-41.

Kwon, et al. A physiology study of *Escherichia coli* overexpressing phosphoenolpyruvate carboxykinase. Biosci Biotechnol Biochem. Apr. 2008;72(4):1138-41.

Kwon, et al. Influence of Gluconeogenic Phosphoenolpyruvate Carboxykinase (PCK) Expression on Succinic Acid Fermentation in *Escherichia coli* Under High Bicarbonate Condition. Journal of Microbiology and Biotechnology. 2006; 16(9):1448-1452.

Lennen, et al. A process for microbial hydrocarbon synthesis: Overproduction of fatty acids in *Escherichia coli* and catalytic conversion to alkanes Biotechnol Bioeng. Jun. 1, 2010;106(2):193-202.

Li, et al. Effect of poxB gene knockout on metabolism in *Escherichia coli* based on growth characteristics and enzyme activities. World Journal of Microbiology and Biotechnology V 23(4). Apr. 2007. p. 573-580.

Lipscomb, et al. Poster—Understanding production of 3-Hydroxypropionic Acid (3-HP) in a genomic context. OPX Biotechnologies. Metabolic Engineering. Sep. 17, 2008.

Lutke-Eversloh, et al. Feedback inhibition of chorismate mutase/prephenate dehydrogenase (TyrA) of *Escherichia coli*: generation and characterization of tyrosine-insensitive mutants. Appl Environ Microbiol. Nov. 2005;71(11):7224-8.

Lynch, et al. SCALEs: multiscale analysis of library enrichment. Nat Methods. Jan. 2007;4(1):87-93.

Lynch, M. Rapid optimization of microorganisms for the cost superior production of chemicals & fuels. OPX Biotechnologies. Sep. 15, 2008.

Magnuson et al. Regulation of fatty acid biosynthesis in *Escherichia coli*. Microbiol Rev. Sep. 1993;57(3):522-42.

Martin, et al. Engineering a mevalonate pathway in *Escherichia coli* for production of terpenoids. Nat Biotechnol. Jul. 2003;21(7):796-802. Epub Jun. 1, 2003.

Mehta, et al. Aminotransferases: demonstration of homology and division into evolutionary subgroups. Eur J Biochem. Jun. 1, 1993;214(2):549-61.

Mohan, et al. Effect of process parameters on 3-hydroxypropionic acid production from glycerol using a recombinant *Escherichia coli*. Appl Microbiol Biotechnol. Sep. 2009;84(4):649-57. Abstract only.

Moreau. Diversion of the metabolic flux from pyruvate dehydrogenase to pyruvate oxidase decreases oxidative stress during glucose metabolism in nongrowing *Escherichia coli* cells incubated under aerobic, phosphate starvation conditions. J Bacteriol. Nov. 2004;186(21):7364-8.

NCBI Reference Sequence: NP_414657.1 (Jan. 16, 1997).
NCBI Reference Sequence: NP_415792.1 (Jan. 16, 1997).
NCBI Reference Sequence: NP_416366.1 (Jan. 16, 1997).
NCBI Reference Sequence: NP_418812.1 (Jan. 16, 1997).
NCBI Reference Sequence: YP_001277512.1 (Jun. 6, 2007).
NCBI Reference Sequence: YP_001433009.1 (Sep. 4, 2007).
NCBI Reference Sequence: YP_001636209.1 (Dec. 21, 2007).
NCBI Reference Sequence: YP_002462600.1 (Dec. 29, 2008).
NCBI Reference Sequence: ZP_01039179.1 (Jan. 16, 2006).
NCBI Reference Sequence: ZP_01626393.1 (Dec. 15, 2006).
NCBI Reference Sequence: ZP_04957196.1 (Sep. 15, 2008).
NCBI Reference Sequence: ZP_05125944.1 (Sep. 15, 2008).

Nexant, Inc. Chemsystems Perp Program, Acrylic Acid, 08/09-3, Jul. 2010.

Office action dated Apr. 29, 2011 for U.S. Appl. No. 12/328,588.
Office action dated Jul. 4, 2011 for EP Applilcation No. 08727619.2.
Office action dated Sep. 17, 2010 for U.S. Appl. No. 12/328,588.

Ohmiya, et al. Structure of cellulases and their applications. Biotechnol Genet Eng Rev. 1997;14:365-414.

Ohnishi, et al. A novel methodology employing Corynebacterium glutamicum genome information to generate a new L-lysine-producing mutant. Appl Microbiol Biotechnol. Feb. 2002;58(2):217-23.

Okamura et al. Unprecedented acetoacetyl-coenzyme A synthesizing enzyme of the thiolase superfamily involved in the mevalonate pathway. Proc Natl Acad Sci U S A. Jun. 22, 2010;107(25):11265-70. Epub Jun. 7, 2010.

Ozcelik et al. Metabolic engineering of aromatic group amino acid pathway in *Bacillus subtilis* for L-phenylalanine production. Chemical Engineering Science. 2004;59(22-23):5019-5026.

(56) References Cited

OTHER PUBLICATIONS

Parikh, et al. Directed evolution of RuBisCO hypermorphs through genetic selection in engineered *E.coli*. Protein Eng Des Sel. Mar. 2006;19(3):113-9. Epub Jan. 19, 2006.
Patnaik, et al. Genome shuffling of Lactobacillus for improved acid tolerance. Nat Biotechnol. Jul. 2002;20(7):707-12.
Pohl et al. A new perspective on thiamine catalysis. Curr Opin Biotechnol. Aug. 2004;15(4):335-42.
Ponce, et al. Cloning of the Two Pyruvate Kinase Isoenzyme StructuralGenes from *Escherichia coli*: the Relative Roles of These Enzymes in Pyruvate Biosynthesis. J Bacteriol. Oct. 1995;177(19):5719-22.
Raj, et al. Effect of process parameters on 3-hydroxypropionic acid production from glycerol using a recombinant *Escherichia coli*. Appl Microbiol Biotechnol. Sep. 2009;84(4):649-57. Epub Apr. 8, 2009.
Ramey, et al. Poster—Translation of genomics data into useful metabolic engineering strategies: construction of a 3-hydroxypropionic acid tolerant *E. coli*. Date unknown.
Ray et al. Mutational analysis of the catalytic and feedback sites of the tryptophan-sensitive 3-deoxy-D-arabino-heptulosonate-7-phosphate synthase of *Escherichia coli*. J Bacteriol. Dec. 1988;170(12):5500-6.
Saier, et al. The catabolite repressor/activator (Cra) protein of enteric bacteria. J Bacteriol. Jun. 1996;178(12):3411-7.
Schmidt-Dannert, et al. Molecular breeding of carotenoid biosynthetic pathways. Nat Biotechnol. Jul. 2000;18(7):750-3.
Service. Sugary Recipe Boosts Grow-Your-Own Plastics. Science. Jun. 30, 2006;312(5782):1861.
Singh, et al. Genes restoring redox balance in fermentation-deficient *E. coli* NZN111. Metab Eng. Nov. 2009;11(6):347-54. Epub Jul. 21, 2009.
Stephanopoulos, et al. Network Rigidity and Metabolic Engineering in Metabolite Overproduction. Science. Jun. 21, 1991;252(5013):1675-81.
Stephanopoulos, et al. Challenges in engineering microbes for biofuels production. Science. Feb. 9, 2007;315(5813):801-4.
Straathoff, et al. Feasibility of acrylic acid production by fermentation. Appl Microbiol Biotechnol. Jun. 2005;67(6):727-34.
Strauss, et al. Enzymes of a novel autotrophic CO2 fixation pathway in the phototrophic bacterium *Chloroflexus aurantiacus*, the 3-hydroxypropionate cycle. Eur J Biochem. Aug. 1, 1993;215(3):633-43.
Tian, et al. Mycobacterium tuberculosis appears to lack an alpha-ketoglutarate dehydrogenase and encodes pyruvate dehydrogenase in widely separated genes. Mol Microbiol. Aug. 2005;57(3):859-68.
Tian, et al. Variant tricarboxylic acid cycle in *Mycobacterium tuberculosis*: Identification of alpha-ketoglutarate decarboxylase. Proc Natl Acad Sci U S A. Jul. 26, 2005;102(30):10670-5. Epub Jul. 18, 2005.
Tunnicliff, et al. The inhibition by substrate analogues of gamma-aminobutyrate aminotransferase from mitochondria of different subcellular fractions of rat brain. Can J Biochem. Apr. 1977;55(4):479-84.
UK combined offce action and search report dated Oct. 25, 2010 for Application No. GB1016137.0.
Vedantam, et al. Characterization of mutations contributing to sulfathiazole resistance in *Escherichia coli*. Antimicrob Agents Chemother. Jan. 1998;42(1):88-93.
Warnecke, et al. A genomics approach to improve the analysis and design of strain selections. Metab Eng. May-Jul. 2008;10(3-4):154-65.
Warnecke, et al. Organic acid toxicity, tolerance, and production in *Escherichia coli* biorefining applications. Microbial Cell Factories. 2005;4(25):1-8.
Warnecke, et al. Rapid dissection of a complex phenotype through genomic-scale mapping of fitness altering genes. Metab Eng. May 2010;12(3):241-50.
Wasewar, et al. Fermentation of Glucose to Lactic Acid Coupled with Reactive Extraction: A Review. Ind. Eng. Chem. Res. 2004; 43:5969-5982.

Werpy, et al. Pacific Northwest National Laboratory. Top Value Added Chemicals From Biomass, vol. 1—Results of Screening for Potential candidates From Sugars and Synthesis Gas, U.S. Department of Energy, Aug. 2004.
Yee, et al. On the role of helix 0 of the tryptophan synthetase alpha chain of *Escherichia coli*. J Biol Chem. Jun. 21, 1996;271(25):14754-63.
Yoshida, et al. Identification of PhoB binding sites of the yibD and ytfK promoter regions in *Escherichia coli*. J Microbiol. Apr. 2011;49(2):285-9. Epub May 3, 2011.
Zha, et al. Improving cellular malonyl-CoA level in *Escherichia coli* via metabolic engineering. Metab Eng. May 2009;11(3):192-8. Epub Feb. 5, 2009.
Zhao et al. Binding of two flaviolin substrate molecules, oxidative coupling, and crystal structure of *Streptomyces coelicolor* A3(2) cytochrome P450 158A2. J Biol Chem. Mar. 25, 2005;280(12):11599-607. Epub Jan. 19, 2005.
Zhou, et al. Interdomain communication between the thiolation and thioesterase domains of EntF explored by combinatorial mutagenesis and selection. Chem Biol. Aug. 2006;13(8):869-79.
U.S. Appl. No. 14/067,838, filed Oct. 30, 2013, Lynch.
U.S. Appl. No. 14/179,188, filed Feb. 12, 2014, Lipscomb.
U.S. Appl. No. 14/182,822, filed Feb. 18, 2014, Gill et al.
U.S. Appl. No. 14/206,462, filed Mar. 12, 2014, Tengler et al.
U.S. Appl. No. 14/213,616, filed Mar. 14, 2014, Hoppe et al.
U.S. Appl. No. 14/213,605, filed Mar. 14, 2014, Hoppe et al.
Bergler, et al. The enoyl-[acyl-carrier-protein] reductase (FabI) of *Escherichia coli*, which catalyzes a key regulatory step in fatty acid biosynthesis, accepts NADH and NADPH as cofactors and is inhibited by palmitoyl-CoA. Eur J Biochem. Dec. 15, 1996;242(3):689-94.
Bloch, et al. Control mechanisms in the synthesis of saturated fatty acids. Annu Rev Biochem. 1977;46:263-98.
European search report and opinion dated Jul. 18, 2013 for EP Application No. 09801031.7.
European search report and opinion dated Sep. 23, 2013 for EP Application No. 10832342.9.
GenBank Accession No. AAC74497.1; Apr. 24, 2007. 2 pgs.
GenBank Accession No. NP 415816.1; available 1997.
GenBank Accession No. NP 415933.1; available 1997.
GenBank Accession No. NP 418045.4; available 1997.
International search report and written opinion dated Nov. 22, 2013 for PCT/US2013/046888.
Kizer, et al. Application of functional genomics to pathway optimization for increased isoprenoid production. Appl Environ Microbiol. May 2008;74(10):3229-41. doi: 10.1128/AEM.02750-07. Epub Mar. 14, 2008.
Kleerebezem, et al. The qmeA (ts) mutation of *Escherichia coli* is localized in the fabI gene, which encodes enoyl-ACP reductase. Res Microbiol. Oct. 1996;147(8):609-13.
Li, et al. Characterization of two temperature-inducible promoters newly isolated from *B. subtilis*. Biochem Biophys Res Commun. Jul. 13, 2007;358(4):1148-53. Epub May 22, 2007.
Office action dated Jan. 23, 2014 for U.S. Appl. No. 13/575,581.
Office action dated Feb. 7, 2014 for U.S. Appl. No. 12/891,790.
Office action dated Feb. 13, 2014 for U.S. Appl. No. 13/062,917.
Office action dated Apr. 15, 2014 for U.S. Appl. No. 13/416,103.
Office action dated Jun. 3, 2013 for U.S. Appl. No. 13/416,103.
Office action dated Jun. 5, 2013 for U.S. Appl. No. 13/284,337.
Office action dated Jun. 19, 2013 for U.S. Appl. No. 12/891,790.
Office action dated Sep. 19, 2013 for U.S. Appl. No. 13/055,138.
Office action dated Oct. 22, 2013 for U.S. Appl. No. 12/891,760.
Office action dated Oct. 23, 2013 for U.S. Appl. No. 12/523,047.
Office action dated Dec. 12, 2013 for U.S. Appl. No. 13/527,799.
Prather, et al. De novo biosynthetic pathways: rational design of microbial chemical factories. Curr Opin Biotechnol. Oct. 2008;19(5):468-74. doi: 10.1016/j.copbio.2008.07.009. Epub Sep. 5, 2008.
Rathnasingh, et al. Development and evaluation of efficient recombinant *Escherichia coli* strains for the production of 3-hydroxypropionic acid from glycerol. Biotechnol Bioeng. Nov. 1, 2009;104(4):729-39. doi: 10.1002/bit.22429.

(56) References Cited

OTHER PUBLICATIONS

Roe, et al. Inhibition of *Escherichia coli* growth by acetic acid: a problem with methionine biosynthesis and homocysteine toxicity. Microbiology. Jul. 2002;148(Pt 7):2215-22.

Tomar, A. Master Thesis. Production of Pyruvate by *Escherichia coli* Using Metabolic Engineering. The University of Georgia, May 2002, pp. 1-171.

Waterson, et al. Enoyl coenzyme A hydratase (crotonase). Catalytic properties of crotonase and its possible regulatory role in fatty acid oxidation. J Biol Chem. Aug. 25, 1972;247(16):5258-65.

Welch, et al. Extensive mosaic structure revealed by the complete genome sequence of uropathogenic *Escherichia coli*. Proc Natl Acad Sci U S A. Dec. 24, 2002;99(26):17020-4. Epub Dec. 5, 2002.

Zhang, et al. Inhibiting bacterial fatty acid synthesis. J Biol Chem. Jun. 30, 2006;281(26):17541-4. Epub Apr. 28, 2006.

U.S. Appl. No. 14/246,372, filed Apr. 7, 2014, Lynch et al.

U.S. Appl. No. 14/275,752, filed May 12, 2014, Lynch et al.

Bonner, et al. A core catalytic domain of the TyrA protein family: arogenate dehydrogenase from Synechocystis. Biochem J. Aug. 15, 2004;382(Pt 1):279-91.

Chao, et al. Selective production of L-aspartic acid and L-phenylalanine by coupling reactions of aspartase and aminotransferase in *Escherichia coli*. Enzyme Microb Technol. Jul. 1, 2000;27(1-2):19-25.

Daruwala, et al. Menaquinone (vitamin K2) biosynthesis: overexpression, purification, and characterization of a new isochorismate synthase from *Escherichia coli*. J. Bacteriol. May 1997;179(10):3133-8.

Giladi, et al. FolM, a new chromosomally encoded dihydrofolate reductase in *Escherichia coli*. J Bacteriol. Dec. 2003;185(23):7015-8.

Milton, et al. In vitro mutagenesis and overexpression of the *Escherichia coli* trpA gene and the partial characterization of the resultant tryptophan synthase mutant alpha-subunits. J Biol Chem. Dec. 15, 1986;261(35):16604-15.

Nichols, et al. Cloning and sequencing of *Escherichia coli* ubiC and purification of chorismate lyase. J Bacteriol. Aug. 1992;174(16):5309-16.

Popp, J. Sequence and overexpression of the menD gene from *Escherichia coli*. J Bacteriol. Aug. 1989;171(8):4349-54.

Ramilo, et al. Overexpression, purification, and characterization of tyrosine-sensitive 3-deoxy-D-arabino-heptulosonic acid 7-phosphate synthase from *Escherichia coli*. Protein Expr Purif. Mar. 1997;9(2):253-61.

Office action dated Jul. 3, 2014 for U.S. Appl. No. 13/916,534.

Office action dated Jul. 10, 2014 for U.S. Appl. No. 12/891,790.

\* cited by examiner

```
                                                                                            SEQ ID NO:
gi|70728869|ref|YP_258618.1|      MQNIIDGFLKFQREAFPQRSELFKQLASTQNPGTLFVTCSDSRVVPELLT  50    792
gi|238754662|ref|ZP_04616015.1|   MQDIIDGFLKFQREVFPQRSELFKRLASTQHPGALFVTCSDSRVVPELLT  50    793
gi|83646817|ref|YP_435252.1|      MKDIIEGFLKFQREAFPERKELFKDLANQQQPRTLFISCSDSRLVPELVT  50    794
gi|206562226|ref|YP_002233024.    MKDIIEGFLKFQRDAYPARAALFRDLARSQNPRALFISCSDSRLVPELVT  50    795
gi|15800068|ref|NP_286080.1|      MKEIIDGFLKFQRDAFPEREALFKQLATQQSPRTLFISCSDSRLVPELVT  50    544
gi|238790503|ref|ZP_04634271.1|   MKEIIDGFLKFQRDAFPERAELFRSLATQQSPKTLFISCSDSRMVPELVT  50    796
gi|104782623|ref|YP_609121.1|     MQDIIDGFLKFQRDAFPERVKLFKDLATQQSPRALFISCSDSRLVPELVT  50    797
gi|170722264|ref|YP_001749952.    MKAIIDGFLKFQKNAFPERVKLFKDLANQQAPKALFISCSDSRLVPELVT  50    798
gi|157369777|ref|YP_001477766.    MKEVIEGFLKFQREAFVERVALFQRLATQQSPRTLFISCSDSRLVPELLT  50    799
gi|188533851|ref|YP_001907648.    MQHIVEGFLNFQKDIFPEQKELFRSLASSQNPKALFISCSDSRLVPELVT  50    800
gi|152985230|ref|YP_001348595.    MRDIIDGFLRFQRDAYPARSQLFKSLATRQAPKALFIACSDSRVVPELLT  50    801
gi|271966225|ref|YP_003340421.    MQDLEEGVARFQRDVFPAKTELFTRLATAHQPATLFISCSDARVVPELIT  50    802
                                  *:  :.**::  . : **  ..   . ** ::.**:.*:*****:.*:

gi|70728869|ref|YP_258618.1|      QQEPGDLFVIRNAGNIVPSYGP-EPGGVSATVEYAVAVLGVSDIVICGHS  99
gi|238754662|ref|ZP_04616015.1|   QREPGELFVIRNAGNIVPSYGP-EPGGVSATVEYAVAVLGVTDVVICGHS  99
gi|83646817|ref|YP_435252.1|      QREPGDLFVIRNAGNIVPPYGP-EPGGVSASVEYAVAALRVTDVVICGHS  99
gi|206562226|ref|YP_002233024.    QREPGDLFVIRNAGNIVPSFGP-EPGGVSASVEYAVAALRVTDVVICGHS  99
gi|15800068|ref|NP_286080.1|      QREPGDLFVIRNAGNIVPSYGP-EPGGVSASVEYAVAALRVSDIVICGHS  99
gi|238790503|ref|ZP_04634271.1|   QREPGDLFVIRNAGNIVPSYGP-EPGGISASVEYAVTALKVTDIVICGHS  99
gi|104782623|ref|YP_609121.1|     QREPGDLFVIRNAGNIVPSYGP-EPGGVSASVEYAVAALQVADIVICGHS  99
gi|170722264|ref|YP_001749952.    QREPGDLFVIRNAGNIVPSYGP-EPGGVSASVEYAVAGLNVADIVICGHS  99
gi|157369777|ref|YP_001477766.    QREPGDLFVIRNAGNIVPSFGP-EPGGVSASVEYAVSALGVEDIVICGHS  99
gi|188533851|ref|YP_001907648.    QQDPGQLFVIRNAGNIVPSFGP-EPGGVSATIEYAVVALGVSDIVICGHS  99
gi|152985230|ref|YP_001348595.    QREPGELFVIRNAGNIVPGYGP-QPGGVSASVEYAVAVLRVADIVVCGHS  99
gi|271966225|ref|YP_003340421.    QSEPGELFVIRTAGNLVPAYAPGSADGVAAGIEYAVAVLGVSDIVVCGHS  100
                                  * :.**:***:***:**.*.*    *  *:..:****.:  *:**:****
```

FIG. 3

| | | |
|---|---|---|
| gi\|707288869\|ref\|YP_258618.1\| | DCGAMTAISTCKCLDHLPAVANWLRHAESAKVINAARQHASPAEHLDALV | 149 |
| gi\|238754662\|ref\|ZP_04616015.1\| | NCGAMSAIAECQCLDHLPAVAAWLRHADSAKLVNAALPHASPKDRLNSLV | 149 |
| gi\|83646817\|ref\|YP_435252.1\| | NCGAMTAVATCQCIDHMPAVAHWLRYADSAKVVNQARKHASERAKIEDMV | 149 |
| gi\|206562261\|ref\|YP_022233024.\| | DCGAMTAIATCQCMDHMPAVGHWLRYADSARVVNEARTHRSERERIDSMV | 149 |
| gi\|15800068\|ref\|NP_286080.1\| | NCGAMTAIASCQCMDHMPAVSHWLRYADSARVVNEARPHSDLPSKAAAMV | 149 |
| gi\|238790503\|ref\|ZP_04634271.1\| | DCGAMTAIAKCHCLDHMPAVKHWLQYADSAKVVNESREYKNIHDKTISMV | 149 |
| gi\|104782623\|ref\|YP_609121.1\| | DCGAMTAIATCKCLDHMPAVAGWLRYADSARVVNEARQHQSPHAKVEAMV | 149 |
| gi\|170722264\|ref\|YP_001749952.\| | DCGAMTAIATCKCLDHMPAVAGWLRYADSAKVVNEARHHVDKPSKVASMV | 149 |
| gi\|157369777\|ref\|YP_001477766.\| | DCGAMTAIATCQCLQHMPTVANWLRYADSAKVVNQAYQHASENEKVSSMV | 149 |
| gi\|188533851\|ref\|YP_001907648.\| | NCGAMKAIATCQCLAPMPAVEHWLRYADAAKAVVEKKNYDTEEDKVNAMV | 149 |
| gi\|152985230\|ref\|YP_001348595.\| | DCGAMGAIASCACLDHLPAVAGWLRHAEAARAMNSAHEHSSDAARLDALV | 149 |
| gi\|271966225\|ref\|YP_003340421.\| | GCGAMTAVADGLDPAALPAVAGWLRHADASRARVTTTETGTG--EVAALV | 148 |
| | .**** *.:  ...   :*.* .:::::  .                .:* | |
| gi\|707288869\|ref\|YP_258618.1\| | RDNVIAQLANLKTHPSVALALEQGRLNLHGWVYDIESGAIVALDGNTQRF | 199 |
| gi\|238754662\|ref\|ZP_04616015.1\| | RENVIAQLANIKTHPSVALACAQGRLRLHGWVYDIETGSIDVLDELTRTF | 199 |
| gi\|83646817\|ref\|YP_435252.1\| | RENVIAQLANLQTHPSVRLALQEGRLTMHGWFYDIESGGIDAYDGSRHAF | 199 |
| gi\|206562261\|ref\|YP_022233024.\| | RENVVAQLANLKTHPAVRLALEEGRLALHGWVYDIESGCIDAYDGATGRF | 199 |
| gi\|15800068\|ref\|NP_286080.1\| | RENVIAQLANLQTHPSVRLALEEGRIALHGWVYDIESGSIAAFDGATRQF | 199 |
| gi\|238790503\|ref\|ZP_04634271.1\| | HENVIAQLANIQTHPSVRLALEEGRLTIHGWVYDIESGLISAFDRASRQF | 199 |
| gi\|104782623\|ref\|YP_609121.1\| | RENVIAQLANIQTHPSVRLALEEGRVALHGWIYDIESGRIDAFDGRTGQF | 199 |
| gi\|170722264\|ref\|YP_001749952.\| | RENVIAQLANIQTHPSVRLALEEGRVTLHGWIYDIETGGIDAFDGSTGTF | 199 |
| gi\|157369777\|ref\|YP_001477766.\| | RENVIAQLNNIKTHPSVALALEQGRLKLHGWVYDIASGGIEALDGETRRF | 199 |
| gi\|188533851\|ref\|YP_001907648.\| | QENVIAQLNNIKTHPSVAVGLRNNALRLHGWVYDIESGAIRALDKDSKKF | 199 |
| gi\|152985230\|ref\|YP_001348595.\| | RHNVIAQLANLRTHPSVARALEQGRLNLHGWVYDIESGRIDALDGASRRF | 199 |
| gi\|271966225\|ref\|YP_003340421.\| | RQNVLTQLANLATHPSVAHALAGKTVTLHGWIYDIGTGTVAELD-ATGRP | 197 |
| | .:::.*: .**.  .    : :.*..*  .  .   * | |

FIG. 3
(Continued)

```
gi|707288869|ref|YP_258618.1|    VSLAEYPHTCALASQASSAA- 219
gi|238754662|ref|ZP_04616015.1|  SPLSAY----SVVSKPTE--- 213
gi|83646817|ref|YP_435252.1|     VPLAEHPEARAIPGKLSHAV- 219
gi|206562261|ref|YP_002233024.   VSLADHPGVRATPATLPVAA- 219
gi|158800068|ref|NP_286080.1|    VPLAANPRVCAIPLRQPTAA- 219
gi|238790503|ref|ZP_04634271.1   VSLAANPNVRAVPAHN---- 215
gi|1047782623|ref|YP_609121.1|   VSLADNPEVRAVSHASRHVA- 219
gi|1707222264|ref|YP_001749952.  VSLAENPEVHAVSQQARHVA- 219
gi|1573697777|ref|YP_001477766.  IPLATNPEVTATPAVSRF--- 217
gi|1885338551|ref|YP_001907648.  VLLSDNPQVHFE--------- 211
gi|152985230|ref|YP_001348595.   VSLAEHPGVRAVGGEPGQAVA 220
gi|271966225|ref|YP_003340421.   SALAV---------------- 202
                                 *:
```

FIG. 3
(Continued)

```
JP1111  ATGGGTTTTCTTCCGGTAAGCGCATTCTGGTAACCGGTGTTGCCAGCAAACTATCCATC
        ::::::::::::::::::::::::::::::::::::::::::::::::::::::::::::
BW2511  ATGGGTTTTCTTCCGGTAAGCGCATTCTGGTAACCGGTGTTGCCAGCAAACTATCCATC
                10        20        30        40        50        60

JP1111  GCCTACGGTATCGCTCAGGCGGATGCACCGCGAAGGAGCTGAACTGGCATTCACCTACCAG
        ::::::::::::::::::::::::::::::::::::::::::::::::::::::::::::
BW2511  GCCTACGGTATCGCTCAGGCGGATGCACCGCGAAGGAGCTGAACTGGCATTCACCTACCAG
                70        80        90       100       110       120

JP1111  AACGACAAACTGAAAGGCCGCGTAGAAGAATTTGCCGCTCAATTGGGTTCTGACATCGTT
        ::::::::::::::::::::::::::::::::::::::::::::::::::::::::::::
BW2511  AACGACAAACTGAAAGGCCGCGTAGAAGAATTTGCCGCTCAATTGGGTTCTGACATCGTT
               130       140       150       160       170       180

JP1111  CTGCAGTGCGATGTTGCAGAAGATGCCAGCATCGACACCATGTTCGCTGAACTGGGGAAA
        ::::::::::::::::::::::::::::::::::::::::::::::::::::::::::::
BW2511  CTGCAGTGCGATGTTGCAGAAGATGCCAGCATCGACACCATGTTCGCTGAACTGGGGAAA
               190       200       210       220       230       240

JP1111  GTTTGGCCGAAATTTGACGGTTTCGTACACTCTATTGGTTTTGCACCTGGCGATCAGCTG
        ::::::::::::::::::::::::::::::::::::::::::::::::::::::::::::
BW2511  GTTTGGCCGAAATTTGACGGTTTCGTACACTCTATTGGTTTTGCACCTGGCGATCAGCTG
               250       260       270       280       290       300
```

FIG. 4A

```
                      310        320        330        340        350        360
JP1111     GATGGTGACTATGTTAACGCCCGTTACCCGTGAAGGCTTCAAAATTGCCCACGACATCAGC
           ::::::::::::::::::::::::::::::::::::::::::::::::::::::::::::
BW2511     GATGGTGACTATGTTAACGCCCGTTACCCGTGAAGGCTTCAAAATTGCCCACGACATCAGC
                      310        320        330        340        350        360

370        380        390        400        410        420
JP1111     TCCTACAGCTTCGTTGCAATGGCAAAAGCTTGCCGCTCCATGCTGAATCCGGGTTCTGCC
           ::::::::::::::::::::::::::::::::::::::::::::::::::::::::::::
BW2511     TCCTACAGCTTCGTTGCAATGGCAAAAGCTTGCCGCTCCATGCTGAATCCGGGTTCTGCC
                      370        380        390        400        410        420

430        440        450        460        470        480
JP1111     CTGCTGACCCCTTTCCTACCTTGGCGCTGAGCGGCGCTATCCCGAACTACAACGTTATGGGT
           ::::::::::::::::::::::::::::::::::::::::::::::::::::::::::::
BW2511     CTGCTGACCCCTTTCCTACCTTGGCGCTGAGCGGCGCTATCCCGAACTACAACGTTATGGGT
                      430        440        450        460        470        480

490        500        510        520        530        540
JP1111     CTGGCAAAAGCGTCTCTGGAAGCGAACGTGCGCTATATGGCGAACGCGATGGGTCCGGAA
           ::::::::::::::::::::::::::::::::::::::::::::::::::::::::::::
BW2511     CTGGCAAAAGCGTCTCTGGAAGCGAACGTGCGCTATATGGCGAACGCGATGGGTCCGGAA
                      490        500        510        520        530        540

550        560        570        580        590        600
JP1111     GGTGTGCGTGTTAACGCCATCTCTGCTGGTCCGATCCGTACTCTGGCGGCCTCCGGTATC
           ::::::::::::::::::::::::::::::::::::::::::::::::::::::::::::
BW2511     GGTGTGCGTGTTAACGCCATCTCTGCTGGTCCGATCCGTACTCTGGCGGCCTCCGGTATC
                      550        560        570        580        590        600
```

FIG. 4A
(Continued)

```
                610        620        630        640        650        660
JP1111 AAAGACTTCCGCAAAAATGCTGGCTCATTGCGAAGCCGTTACCCCGATTCGCCGTACCGTT
       ::::::::::::::::::::::::::::::::::::::::::::::::::::::::::::
BW2511 AAAGACTTCCGCAAAAATGCTGGCTCATTGCGAAGCCGTTACCCCGATTCGCCGTACCGTT
                610        620        630        640        650        660

670        680        690        700        710        720
JP1111 ACTATTGAAGATGTGGGTAACTCTGCGGCATTCCTGTGCTCCGATCTCTCTGCCGGTATC
       ::::::::::::::::::::::::::::::::::::::::::::::::::::::::::::
BW2511 ACTATTGAAGATGTGGGTAACTCTGCGGCATTCCTGTGCTCCGATCTCTCTGCCGGTATC
                670        680        690        700        710        720

730        740        750        760        770        780
JP1111 TTCGGTGAAGTGGTCCACGTTGACGGGCGGTTTCAGCATTGCTGCAATGAACGAACTCGAA
       :: ::::::::::::::::::::::::::::::::::::::::::::::::::::::::::
BW2511 TCCGGTGAAGTGGTCCACGTTGACGGGCGGTTTCAGCATTGCTGCAATGAACGAACTCGAA
                730        740        750        760        770        780
```

FIG. 4A
(Continued)

```
JP1111  MGFLSGKRILVTGVASKLSIAYGIAQAMHREGAELAFTYQNDKLKGRVEEFAAQLGSDIV  : :
BW2511  MGFLSGKRILVTGVASKLSIAYGIAQAMHREGAELAFTYQNDKLKGRVEEFAAQLGSDIV  : 60
             10        20        30        40        50        60

JP1111  LQCDVAEDASIDTMFAELGKVWPKFDGFVHSIGFAPGDQLDGDYVNAVTREGFKIAHDIS  : :
BW2511  LQCDVAEDASIDTMFAELGKVWPKFDGFVHSIGFAPGDQLDGDYVNAVTREGFKIAHDIS  : 120
             70        80        90       100       110       120

JP1111  SYSFVAMAKACRSMLNPGSALLTLSYLGAERAIPNYNVMGLAKASLEANVRYMANAMGPE  : :
BW2511  SYSFVAMAKACRSMLNPGSALLTLSYLGAERAIPNYNVMGLAKASLEANVRYMANAMGPE  : 180
            130       140       150       160       170       180

JP1111  GVRVNAISAGPIRTLAASGIKDFRKMLAHCEAVTPIRRTVTIEDVGNSAAFLCSDLSAGI  : :
BW2511  GVRVNAISAGPIRTLAASGIKDFRKMLAHCEAVTPIRRTVTIEDVGNSAAFLCSDLSAGI  : 240
            190       200       210       220       230       240

JP1111  FGEVVHVDGGFSIAAMNELELK  : :
BW2511  SGEVVHVDGGFSIAAMNELELK  : 260
            250       260
```

FIG. 4B

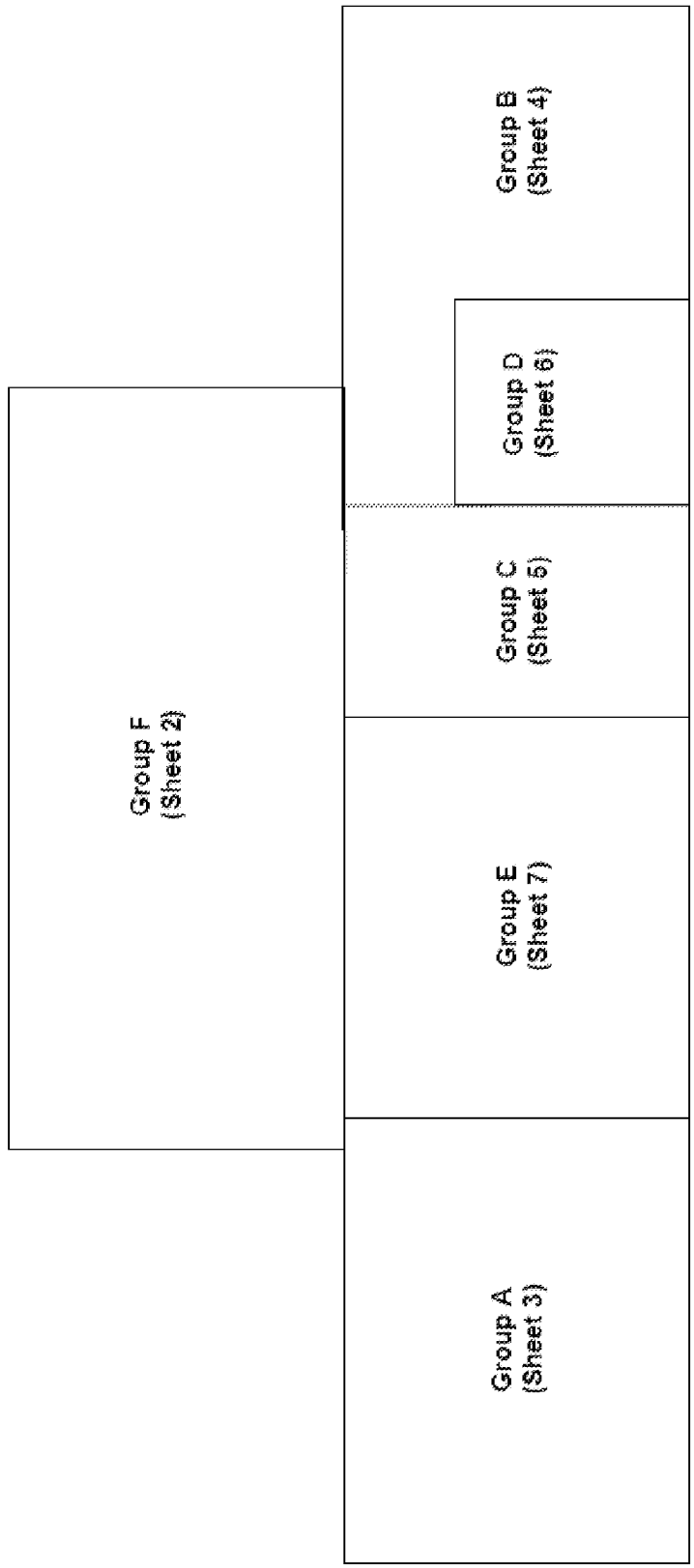
FIG. 9A, SHEET 1 (E. coli 3HPTGC)

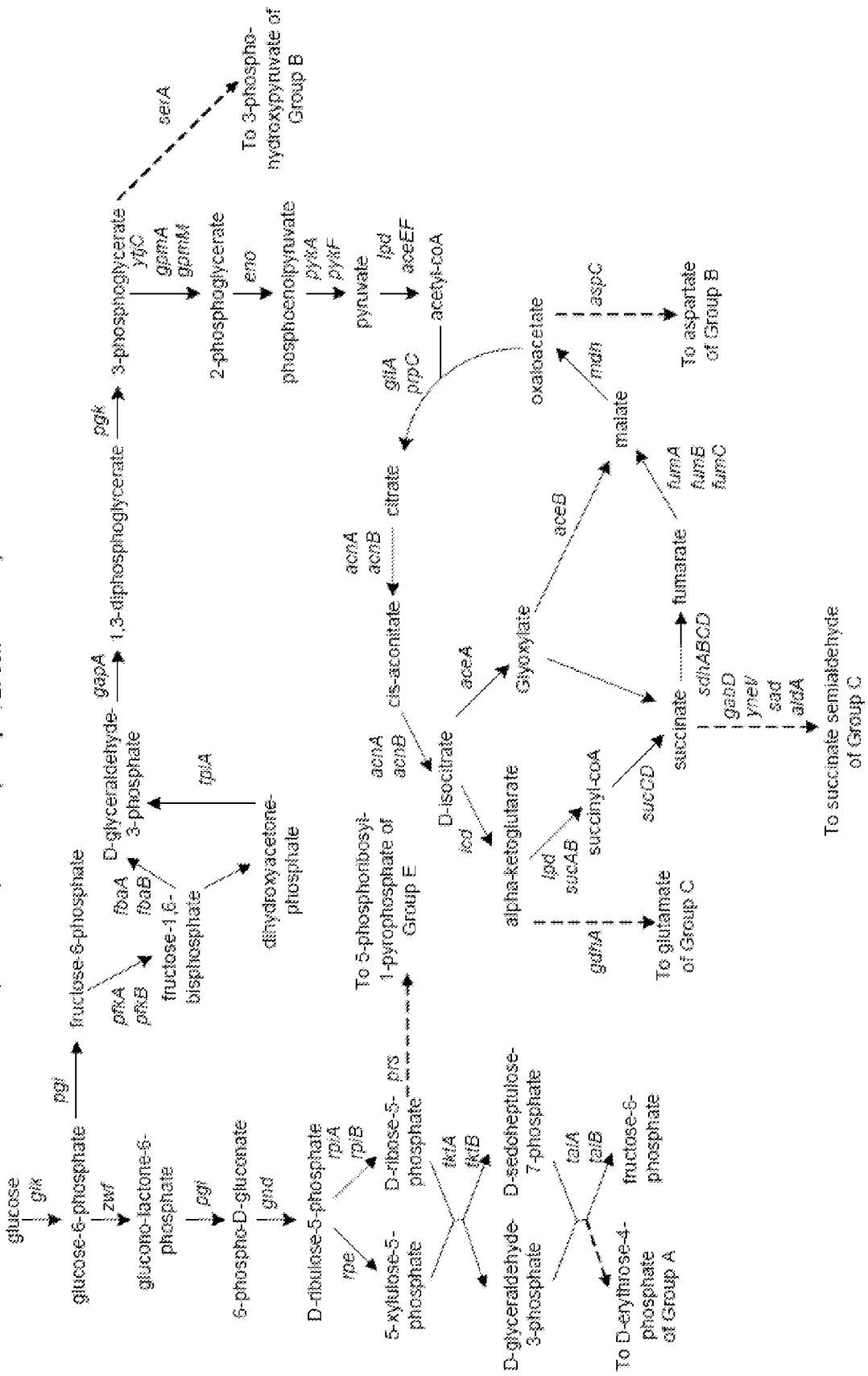
FIG. 9A (Continued), SHEET 2 (Group F, E. coli 3HPTGC)

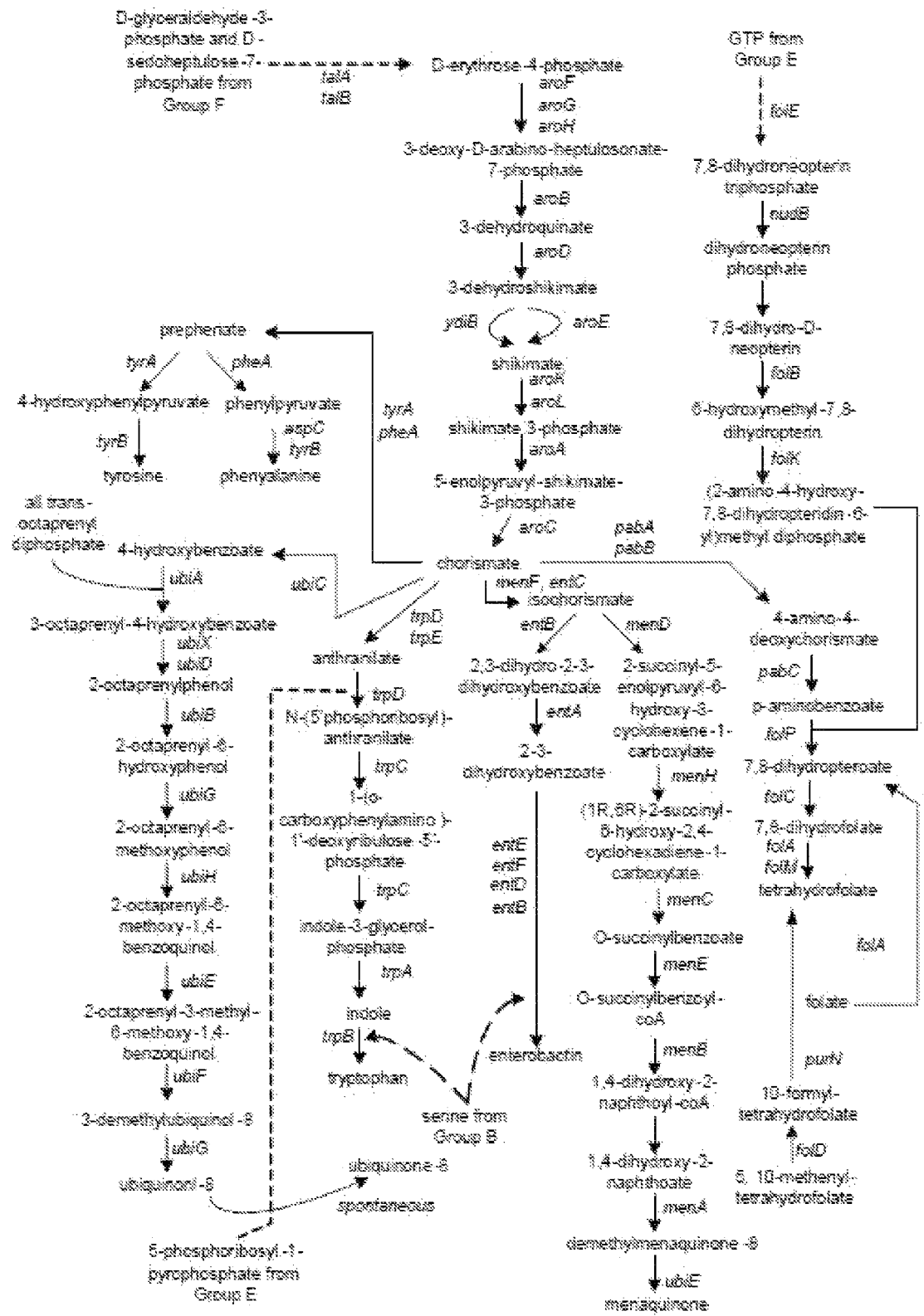
FIG. 9A (Continued), SHEET 3 (Group A, E. coli 3HPTGC)

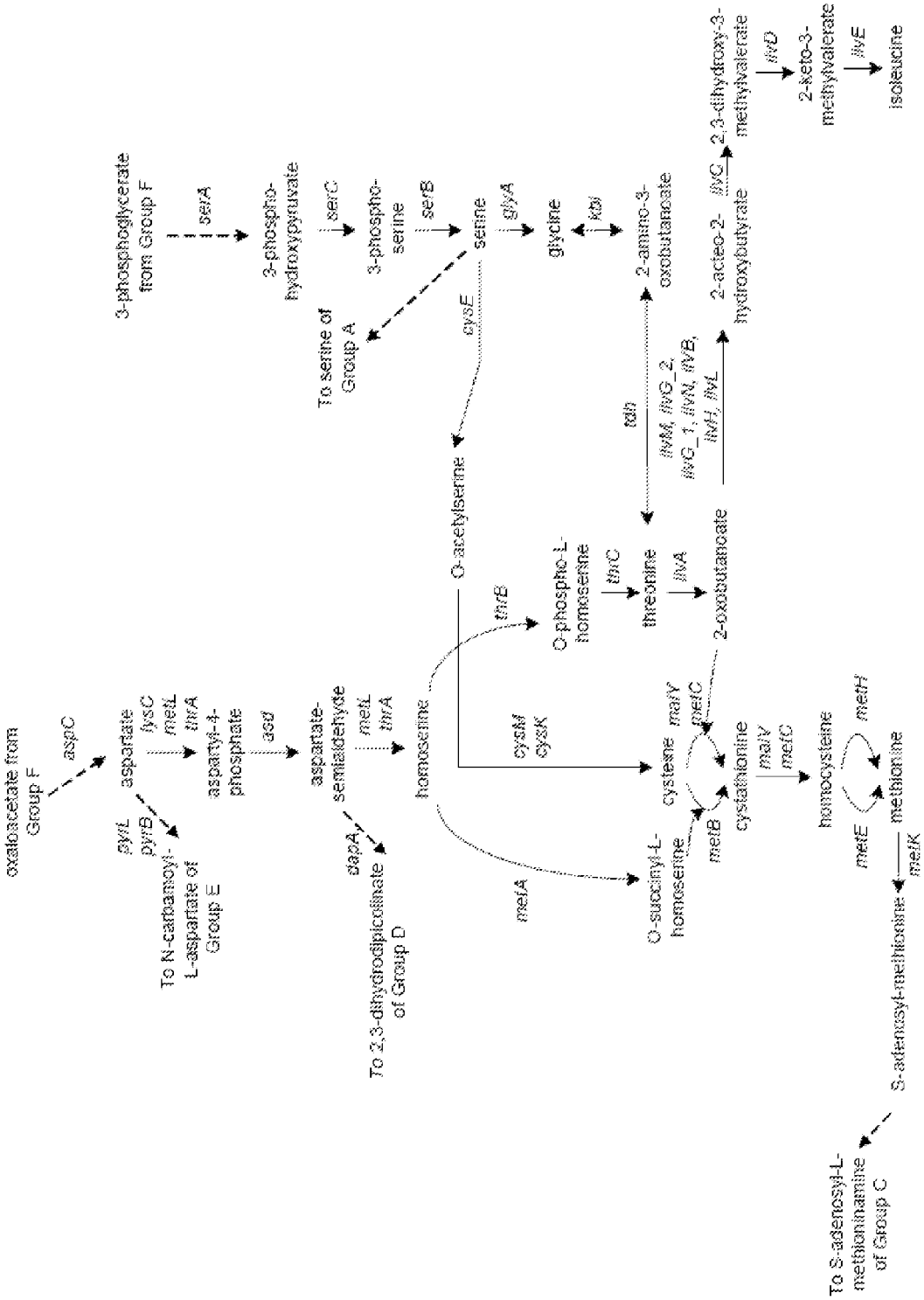
FIG. 9A (Continued), SHEET 4 (Group B, E. coli 3HPTGC)

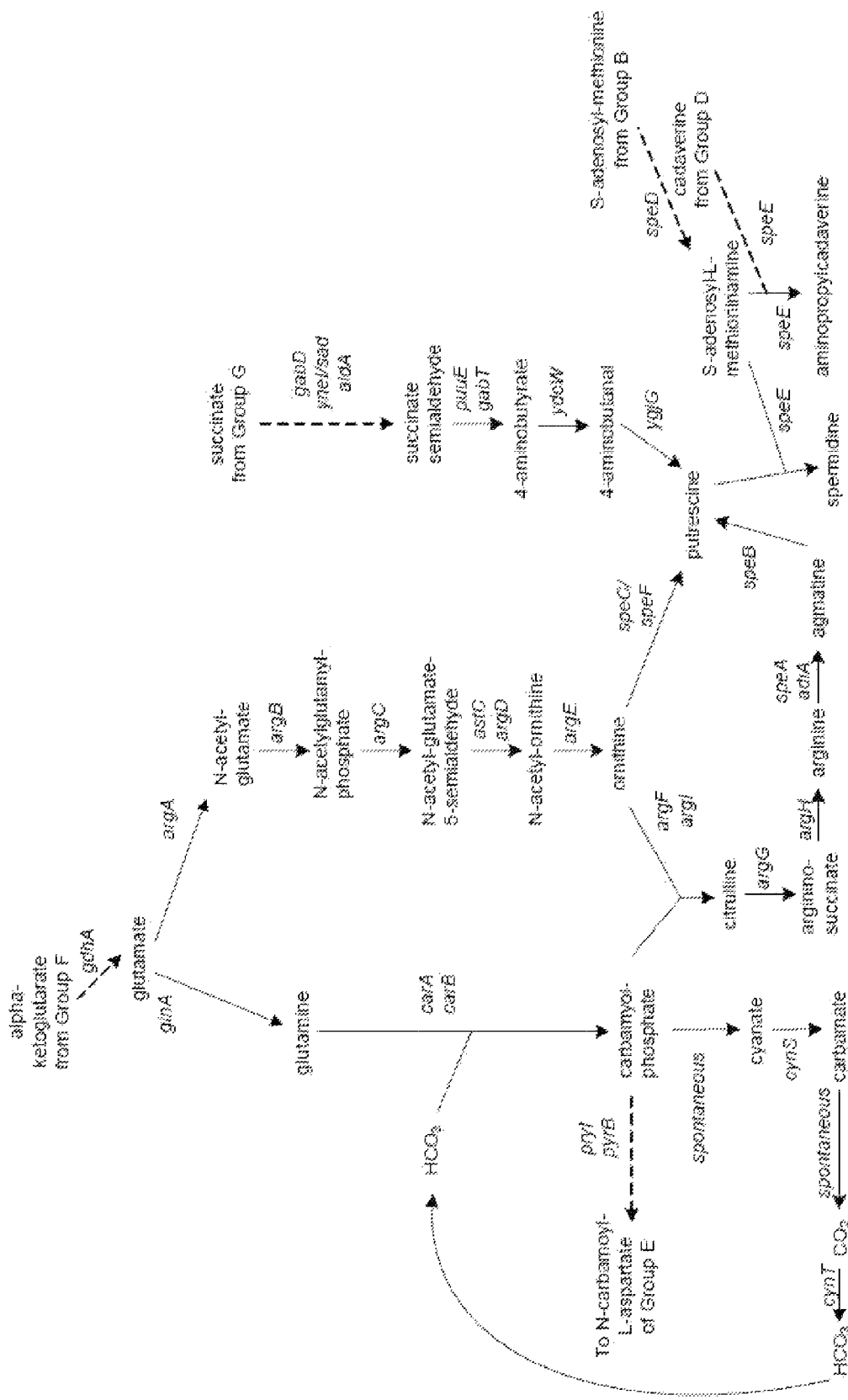
FIG. 9A (Continued), SHEET 5 (Group C, E. coli 3HPTGC)

FIG. 9A (Continued), SHEET 6 (Group D, E.coli 3HPTGC)
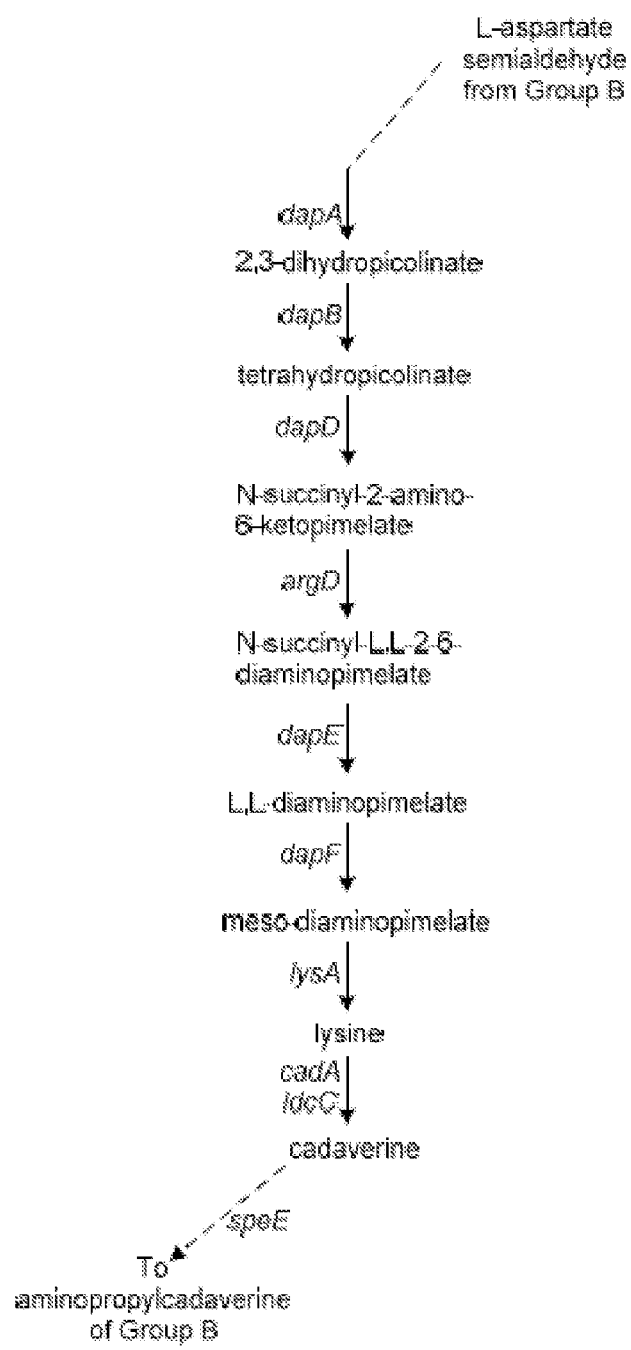

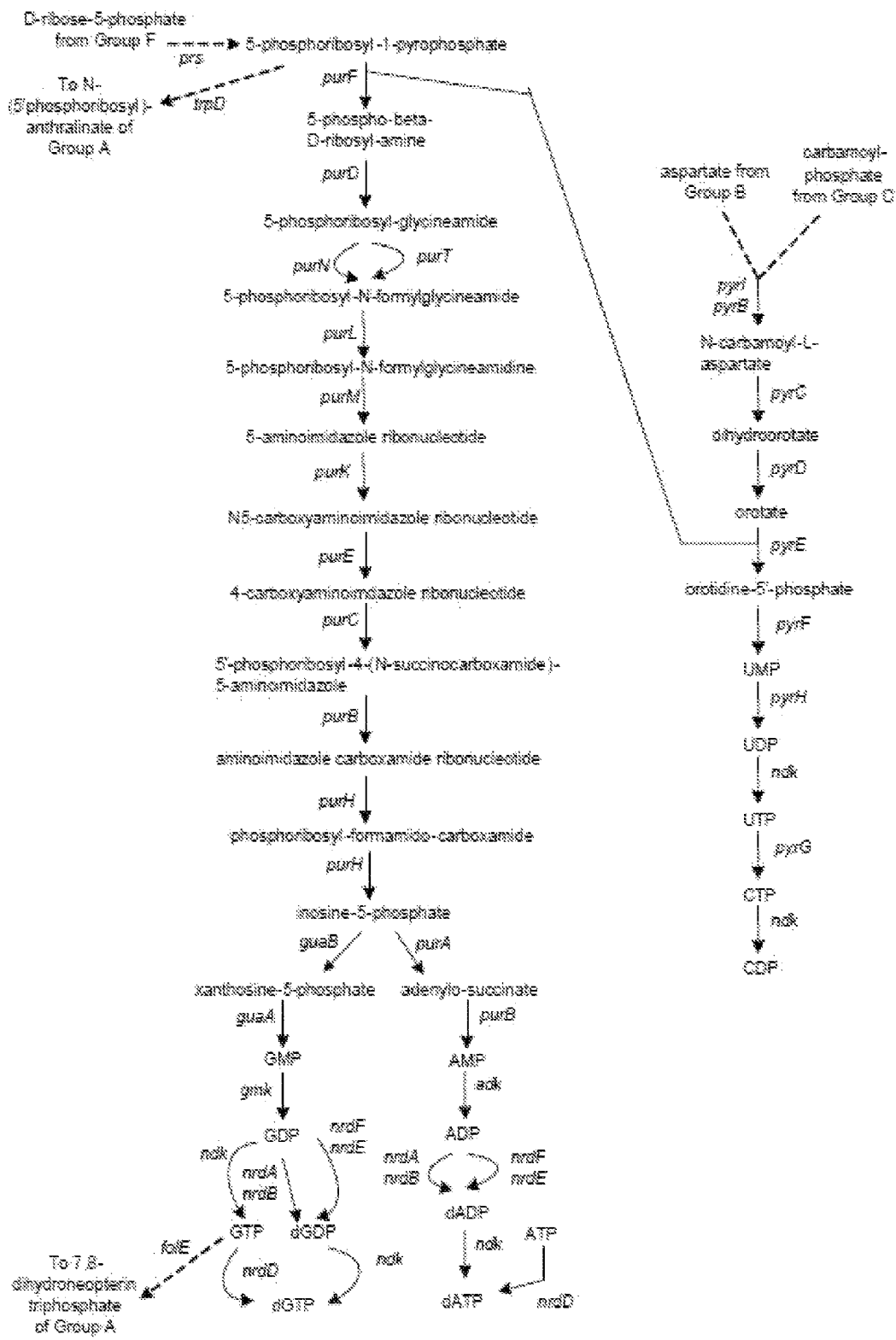
FIG. 9A (Continued), SHEET 7 (Group E, E. coli 3HPTGC)

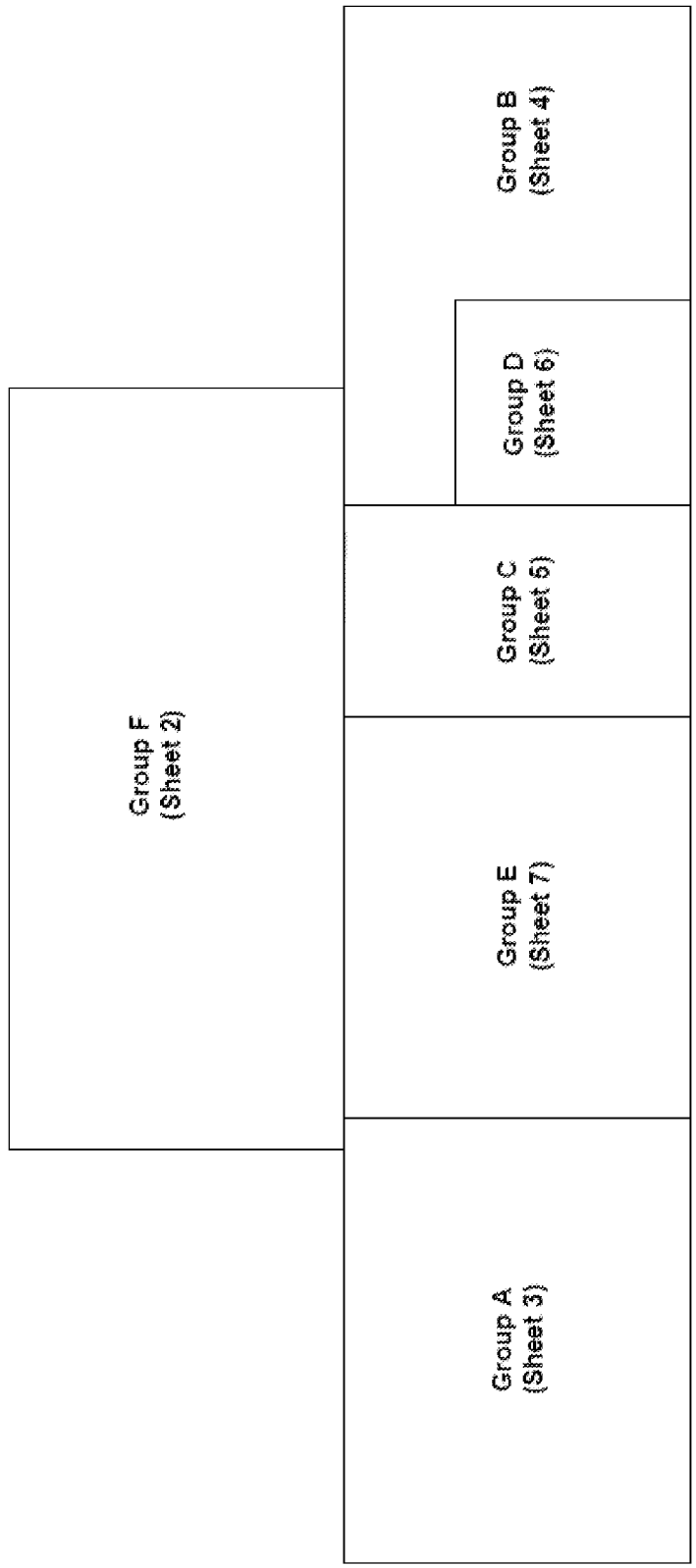
FIG. 9B, SHEET 1 (*Bacillus subtilis* 3HPTGC)

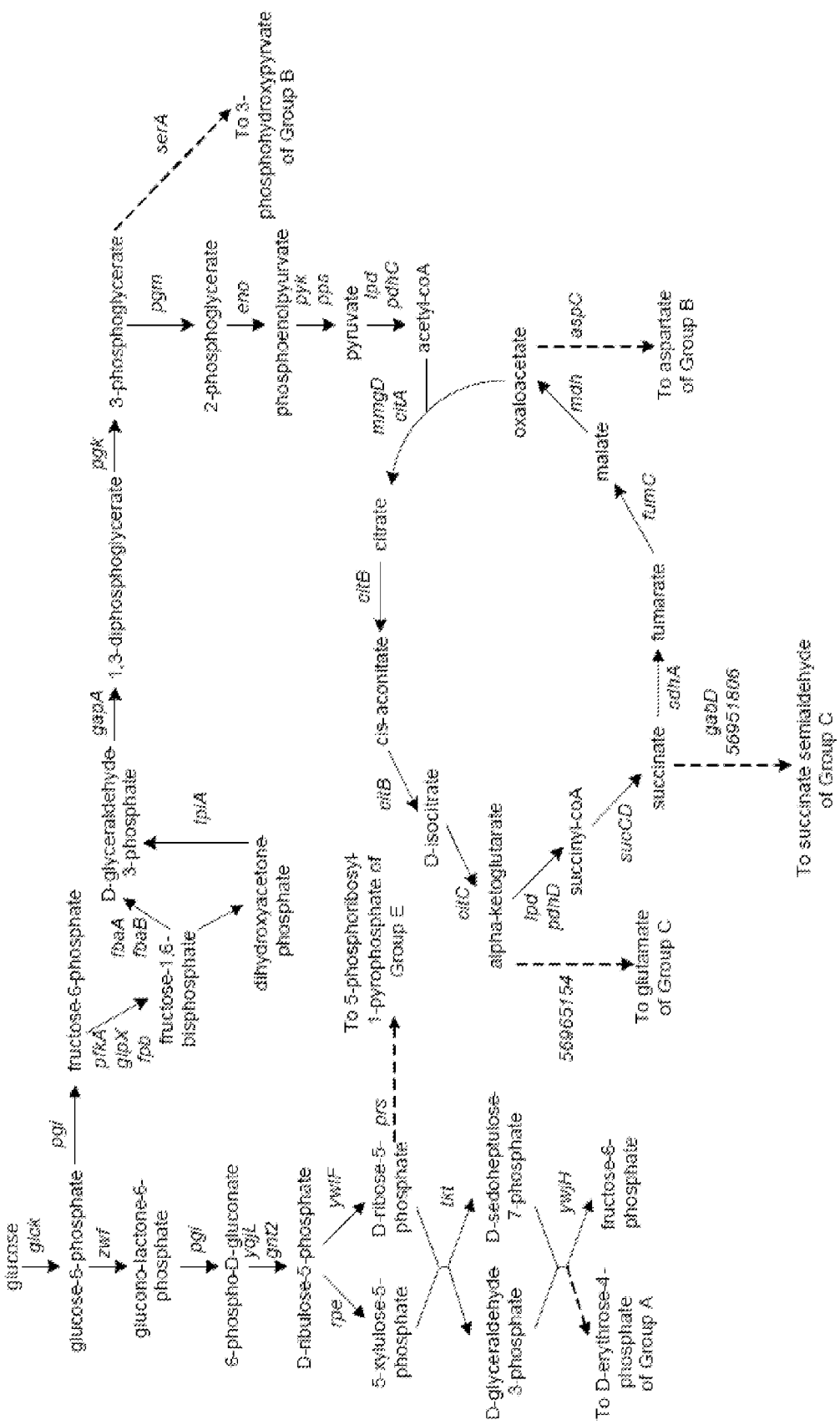
FIG. 9B (Continued), SHEET 2 (Group F, Bacillus subtilis 3HPTGC)

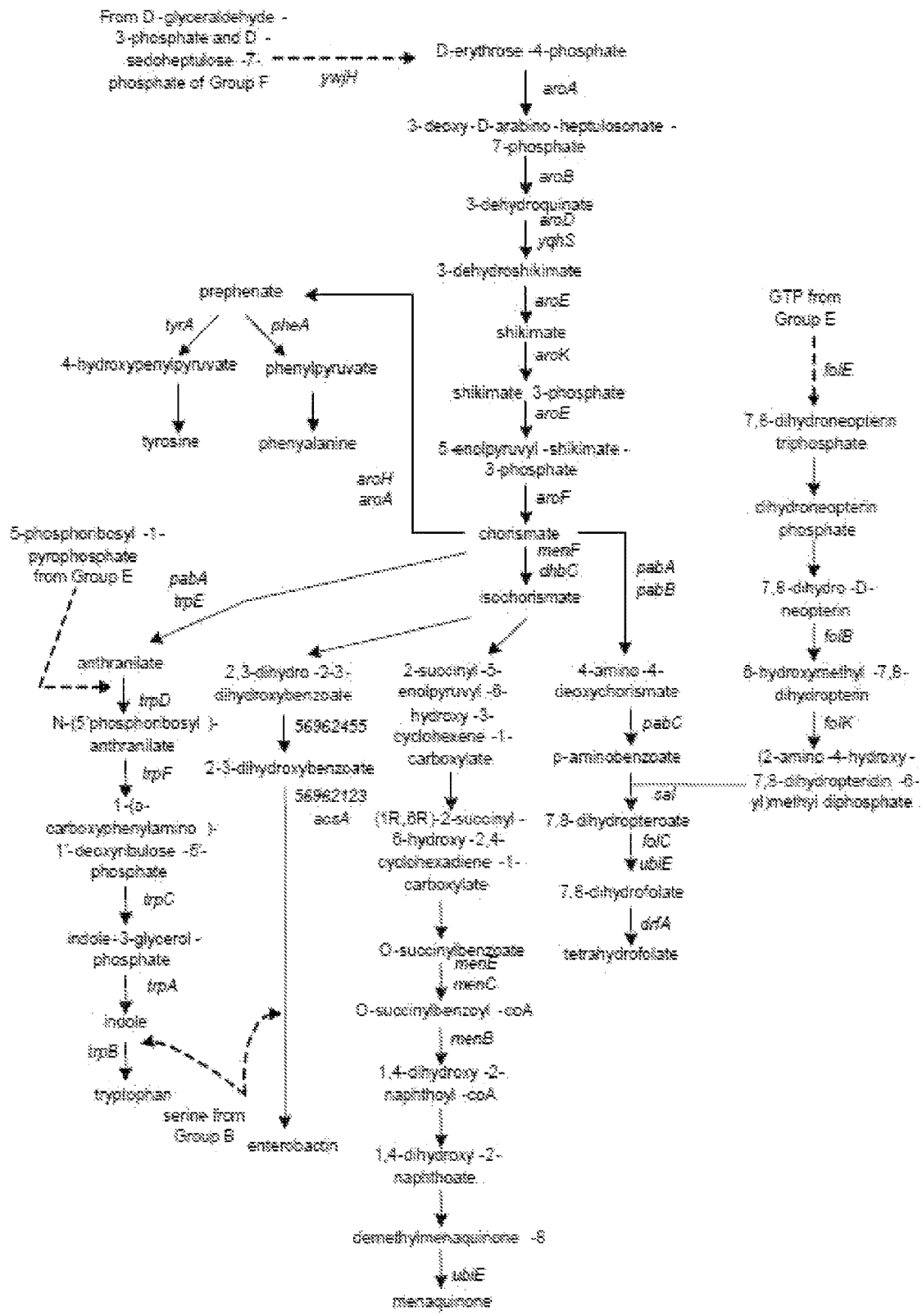
FIG. 9B (Continued), SHEET 3 (Group A, *Bacillus subtilis* 3HPTGC)

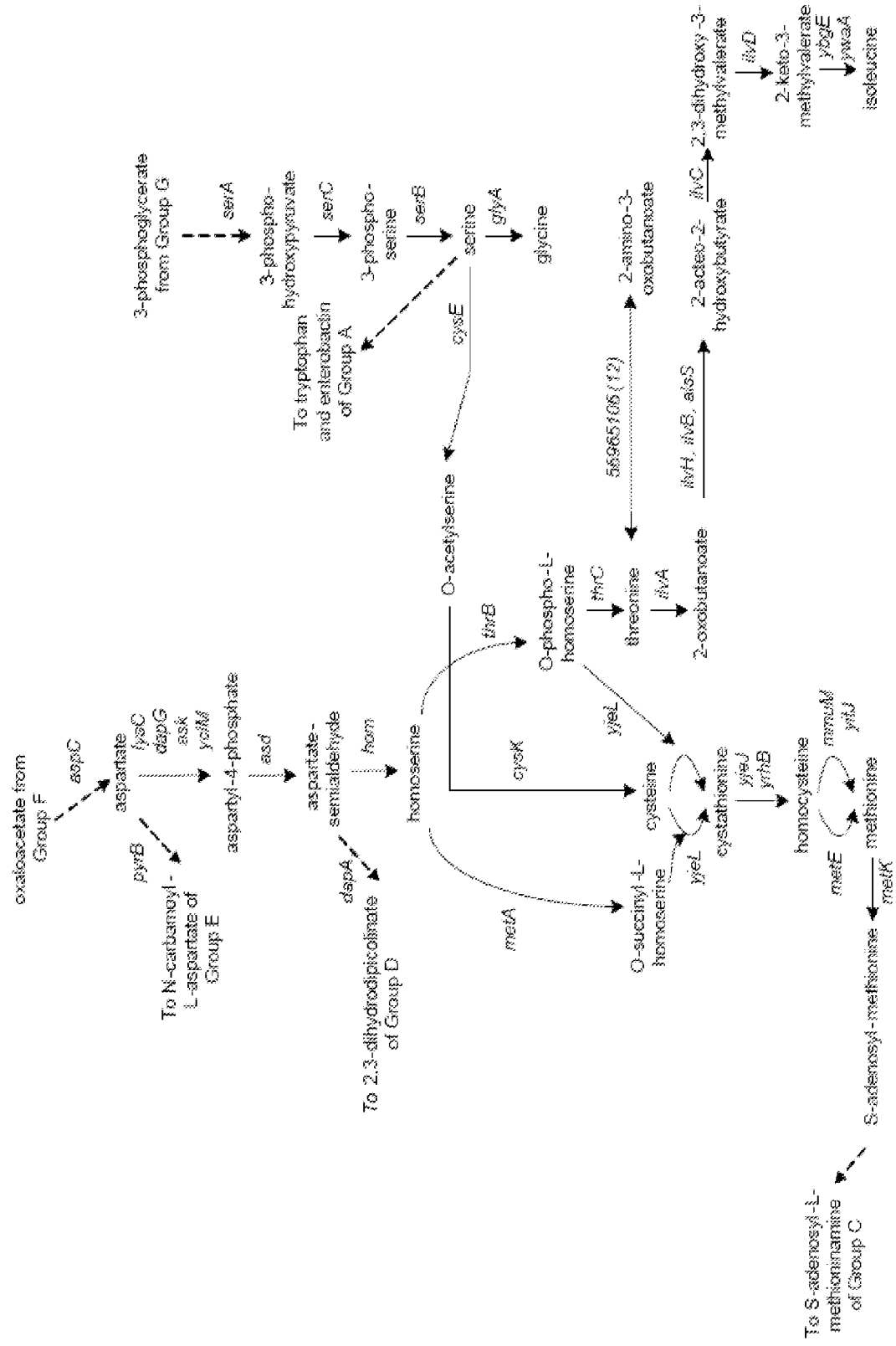
FIG. 9B (Continued), SHEET 4 (Group B, Bacillus subtilis 3HPTGC)

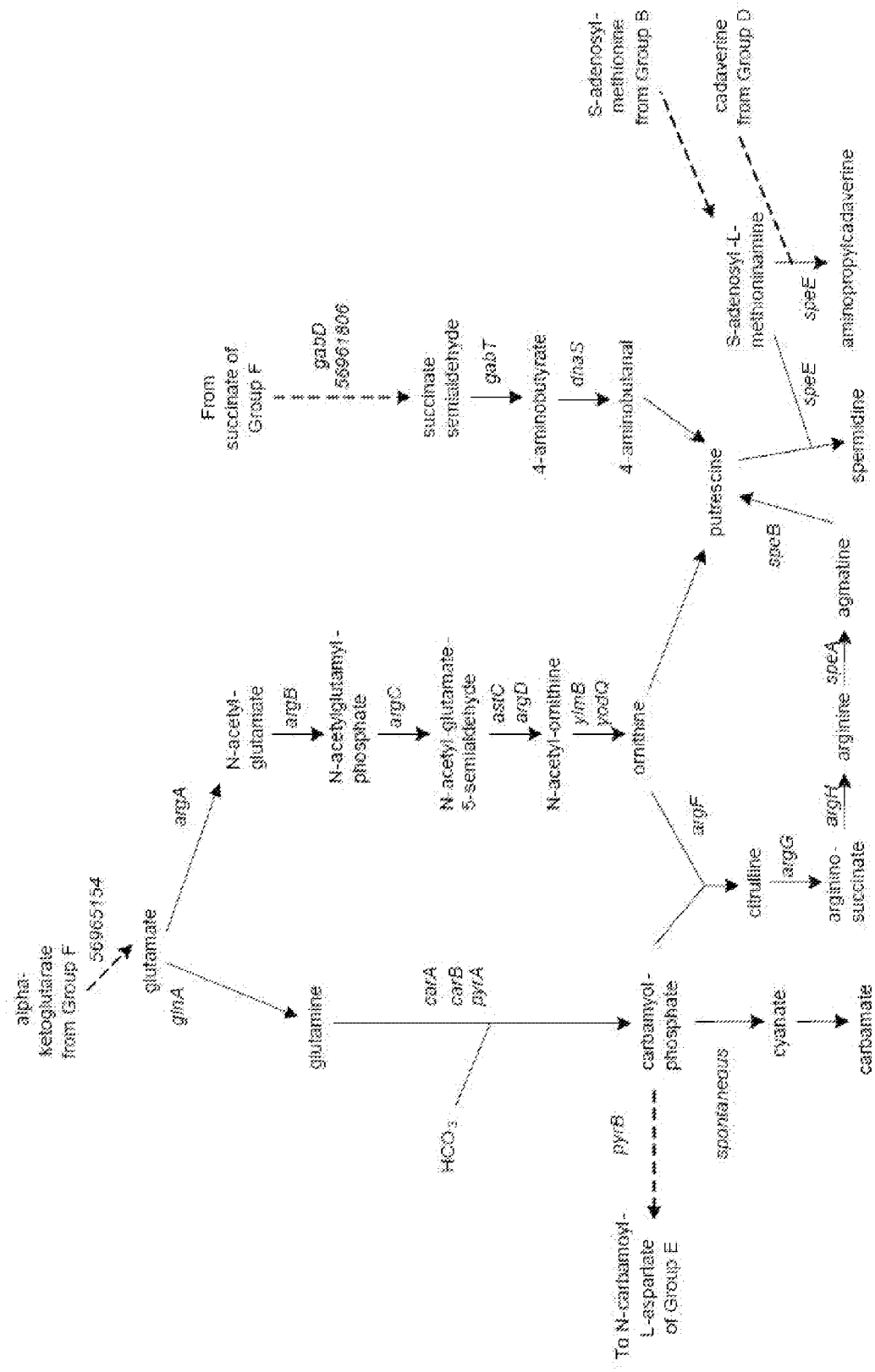
FIG. 9B (Continued), SHEET 5 (Group C, Bacillus subtilis 3HPTGC)

FIG. 9B (Continued), SHEET 6 (Group D, Bacillus subtilis 3HPTGC)
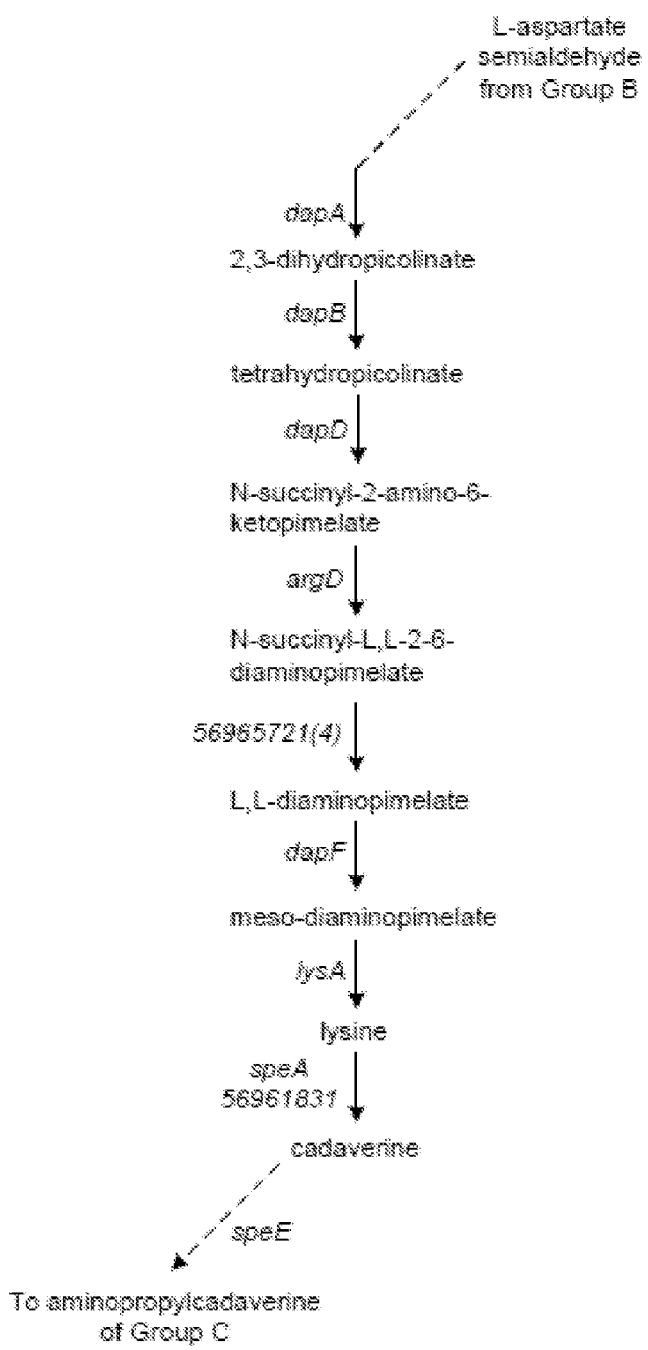

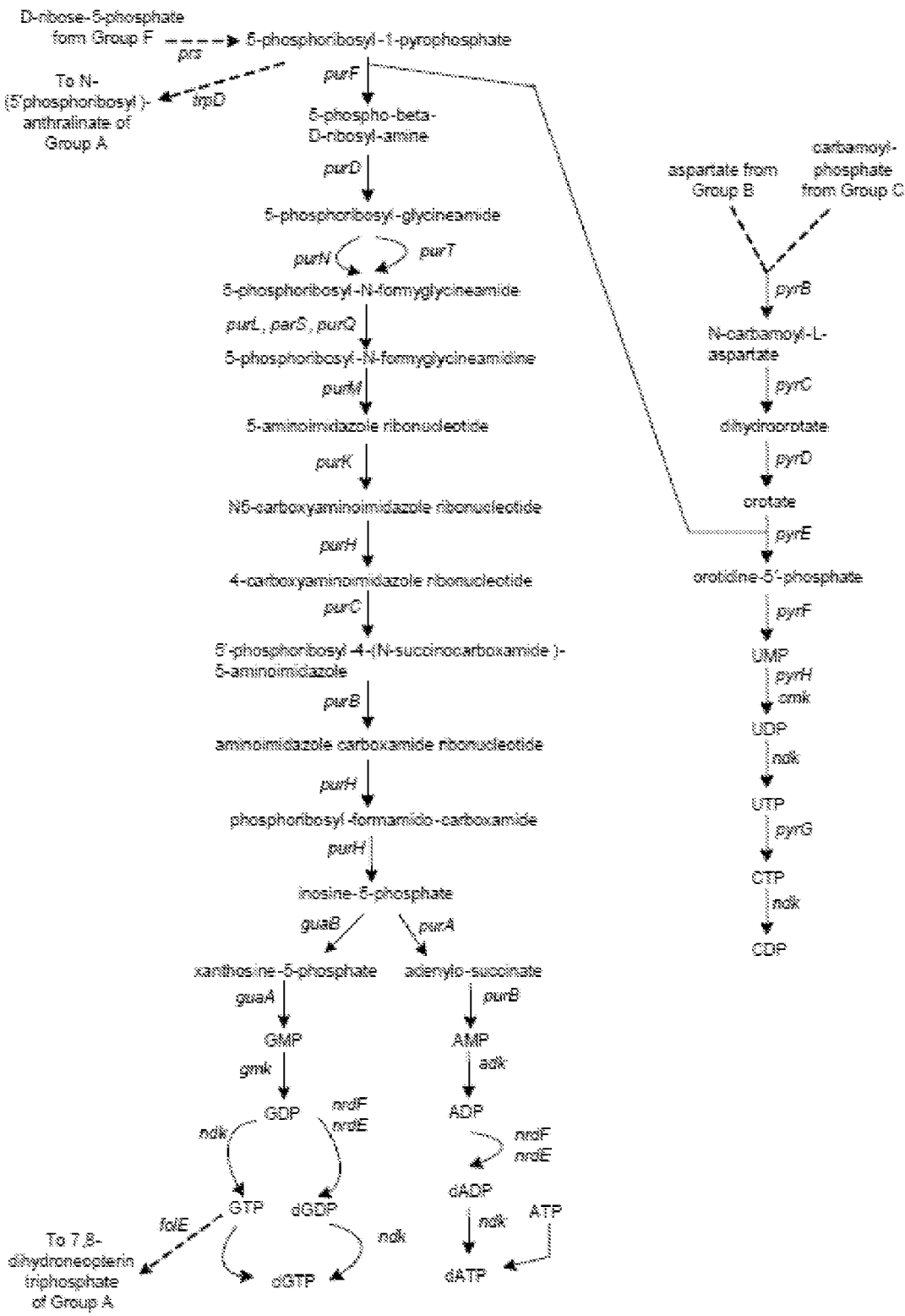
FIG. 9B (Continued), SHEET 7 (Group E, *Bacillus subtilis* 3HPTGC)

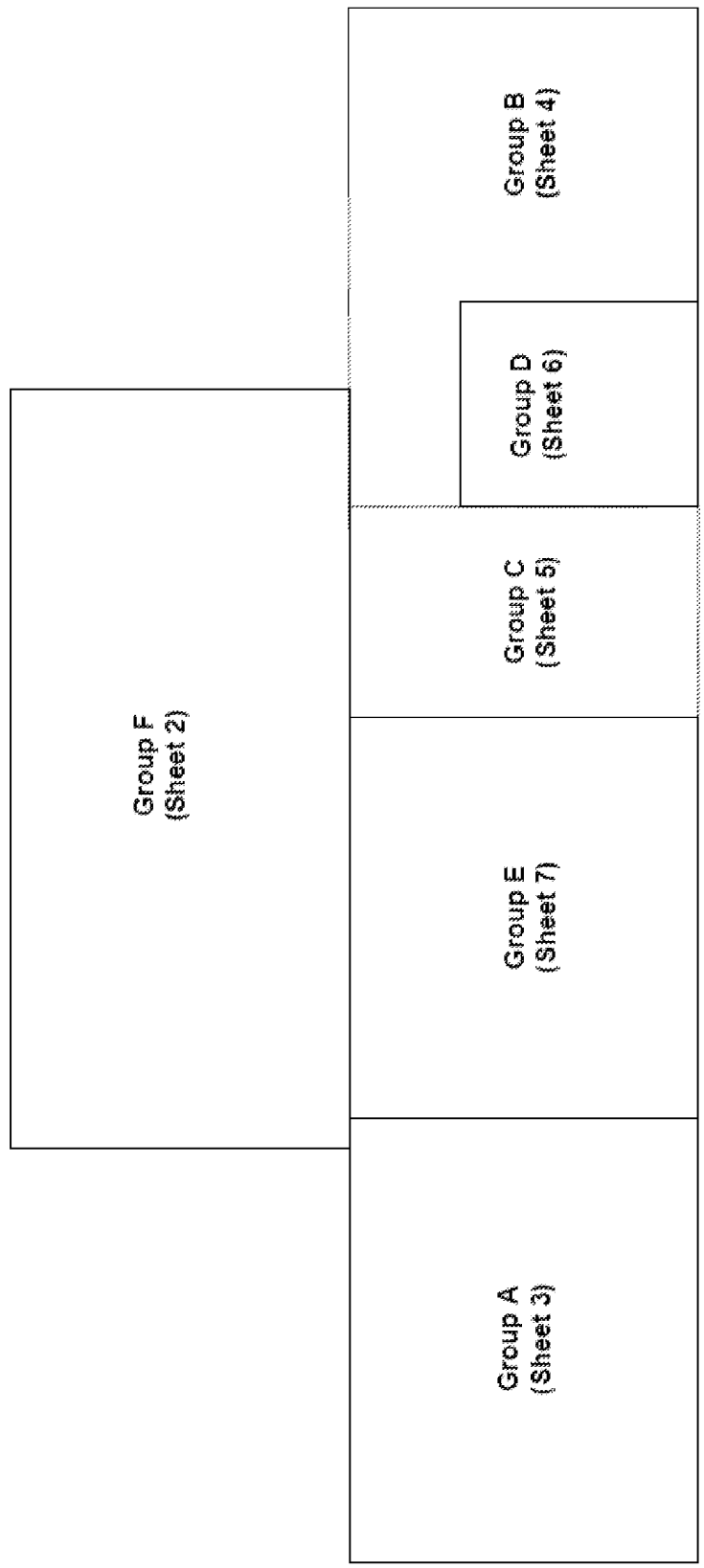
FIG. 9C SHEET 1 (*Saccharomyces cerevisiae* 3HPTGC)

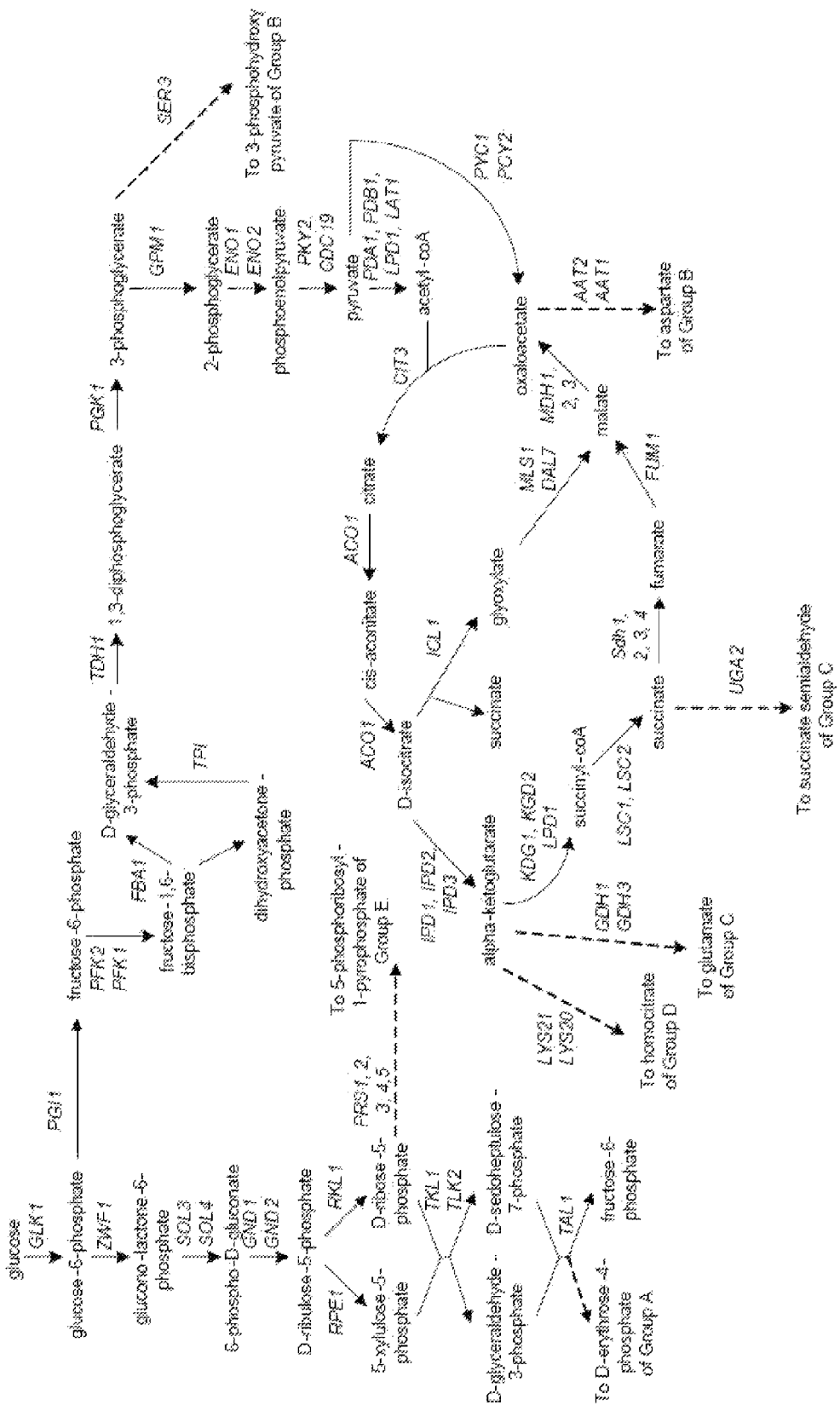
FIG. 9C (Continued), SHEET 2 (Group F, Saccharomyces cerevisiae 3HPTGC)

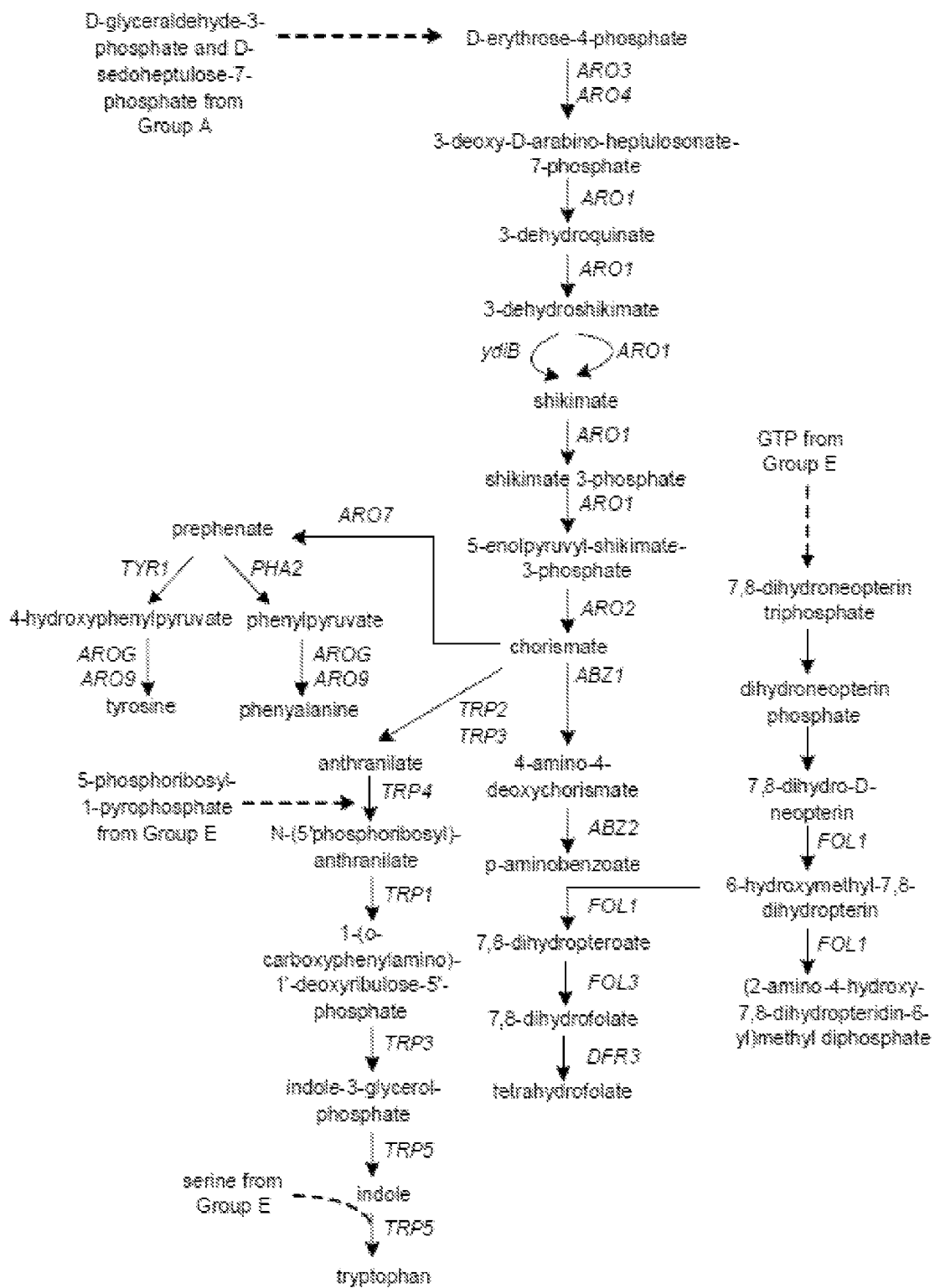
FIG. 9C (Continued), SHEET 3 (Group A, *Saccharomyces cerevisiae* 3HPTGC)

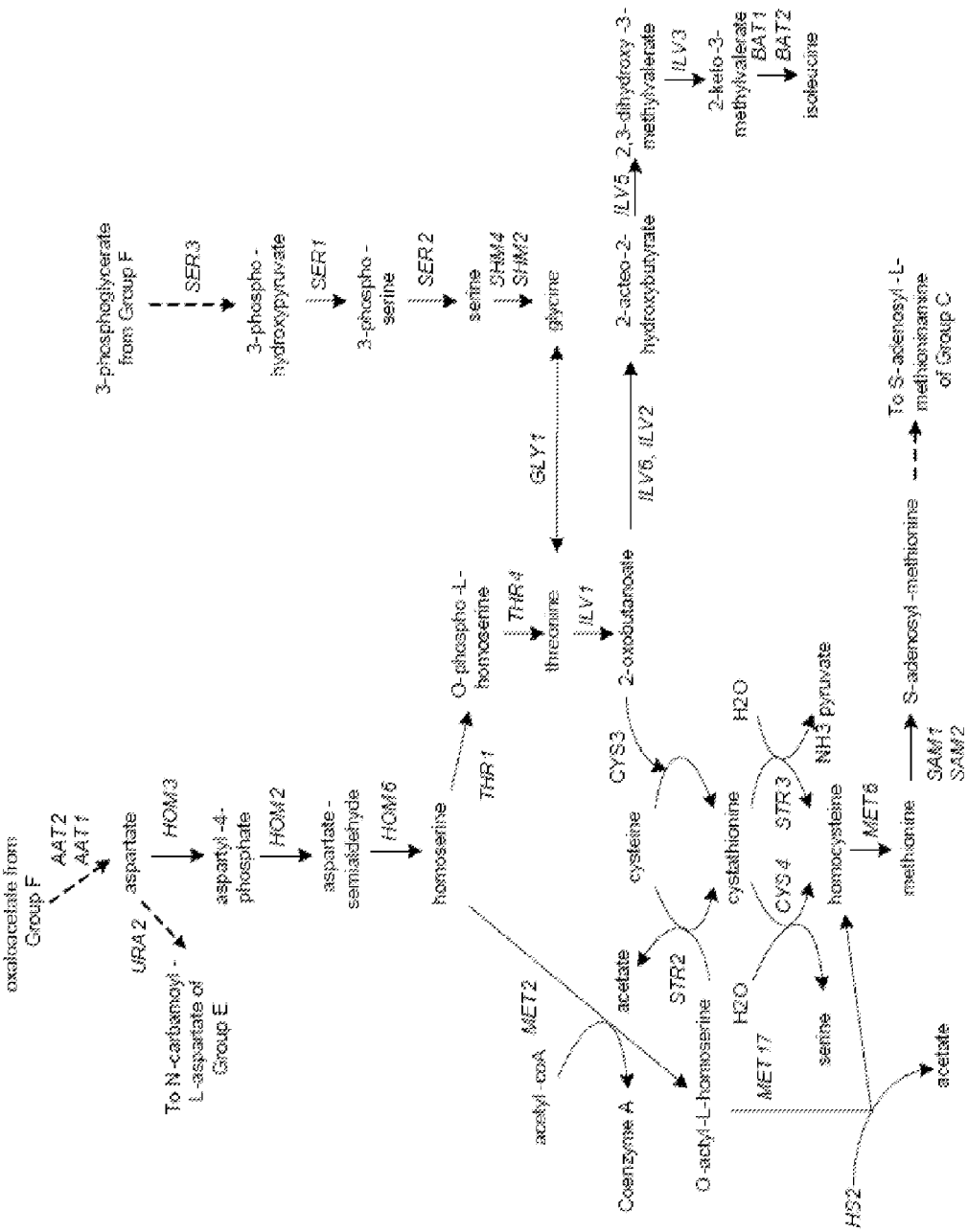
FIG. 9C (Continued), SHEET 4 (Group B, Saccharomyces cerevisiae 3HPTGC)

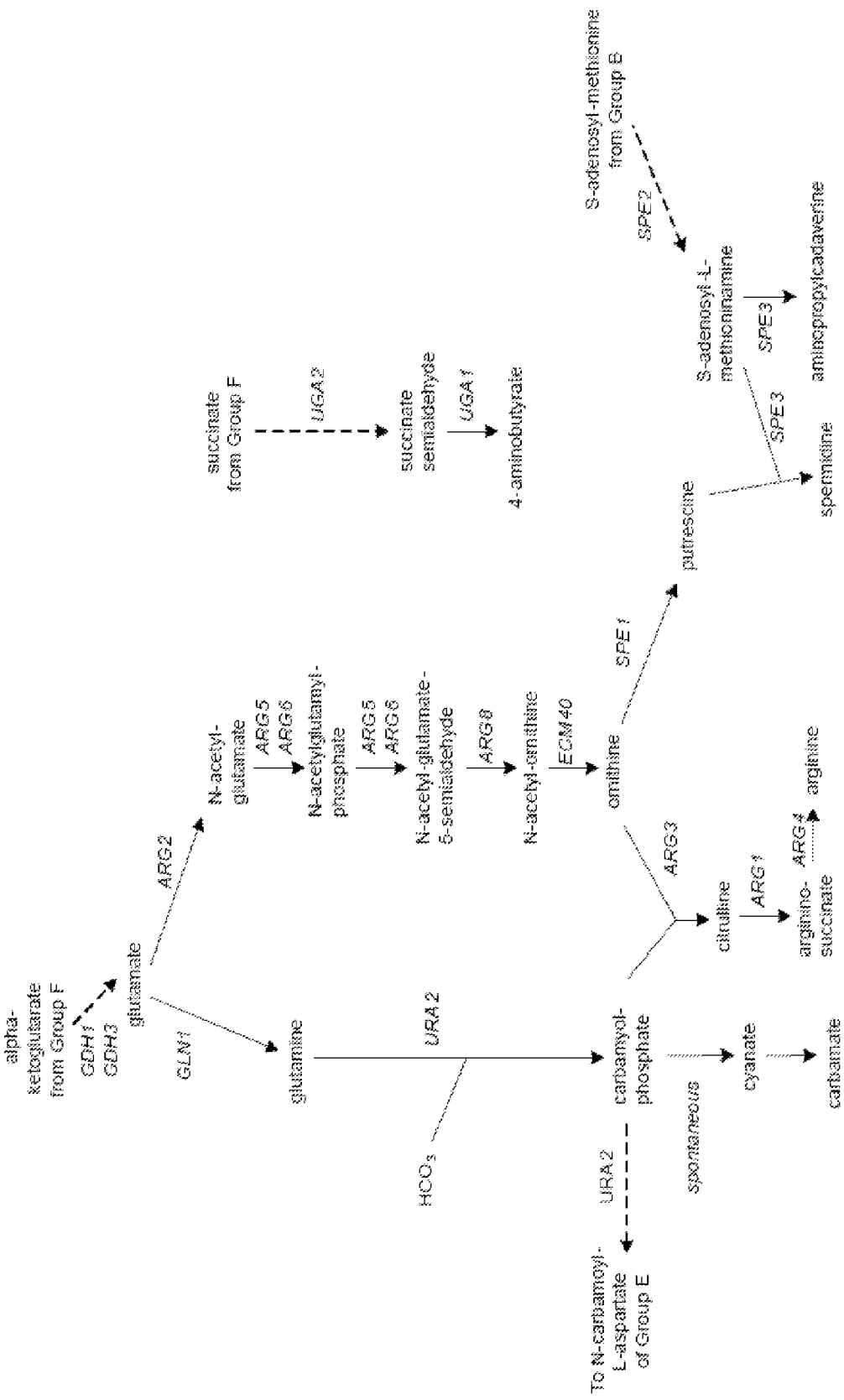
FIG. 9C (Continued), SHEET 5 (Group C, Saccharomyces cerevisiae 3HPTGC)

FIG. 9C (Continued), SHEET 6 (Group D, Saccharomyces cerevisiae 3HPTGC)

alpha-ketoglutarate
from Group F

| LYS21
| LYS20
↓

Homocitrate

LYS4 ↓

Homoaconitate

LYS4 ↓

Homo-isocitrate

LYS12 ↓ alpha-ketoadipate

↓

L-2-Aminoadipate

LYS2 ↓

L-2-Aminoadipate
6-semialdehyde

LYS9 ↓

Saccharopine

LYS1 ↓

L-Lysine

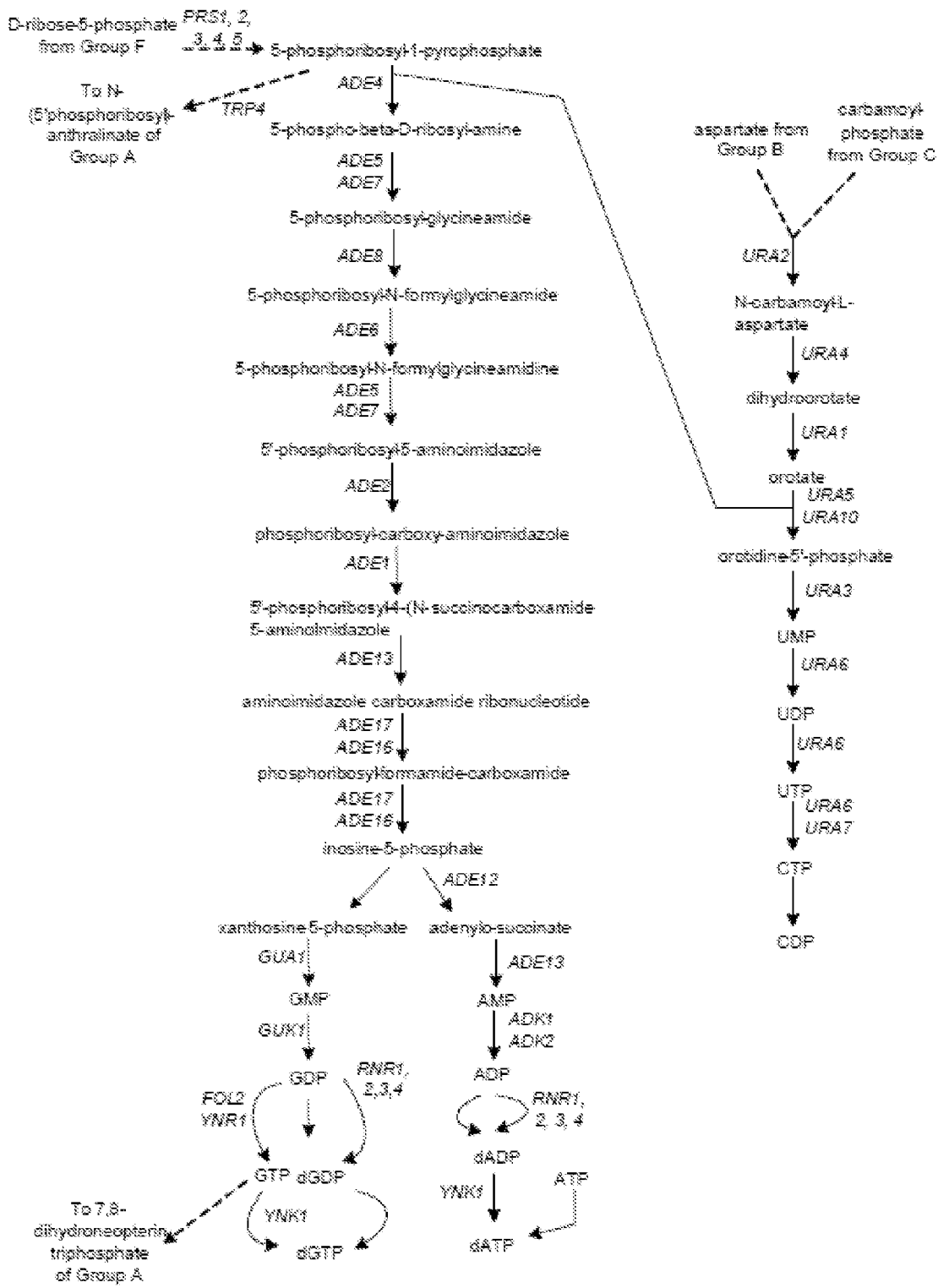
FIG. 9C (Continued), SHEET 7 (Group E Saccharomyces cerevisiae3HPTGC)

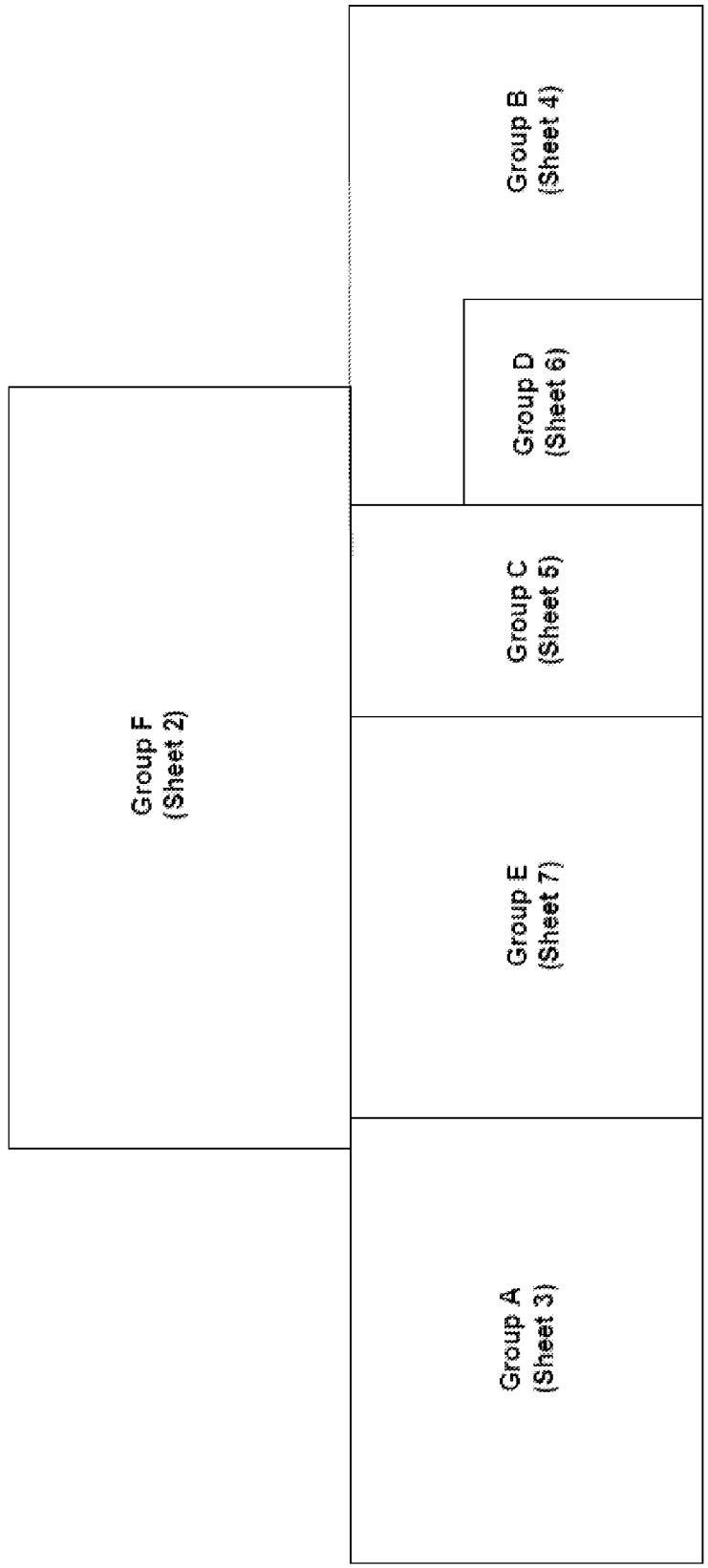
FIG. 9D, SHEET 1 (*Cupriavidus necator* 3HPTGC)

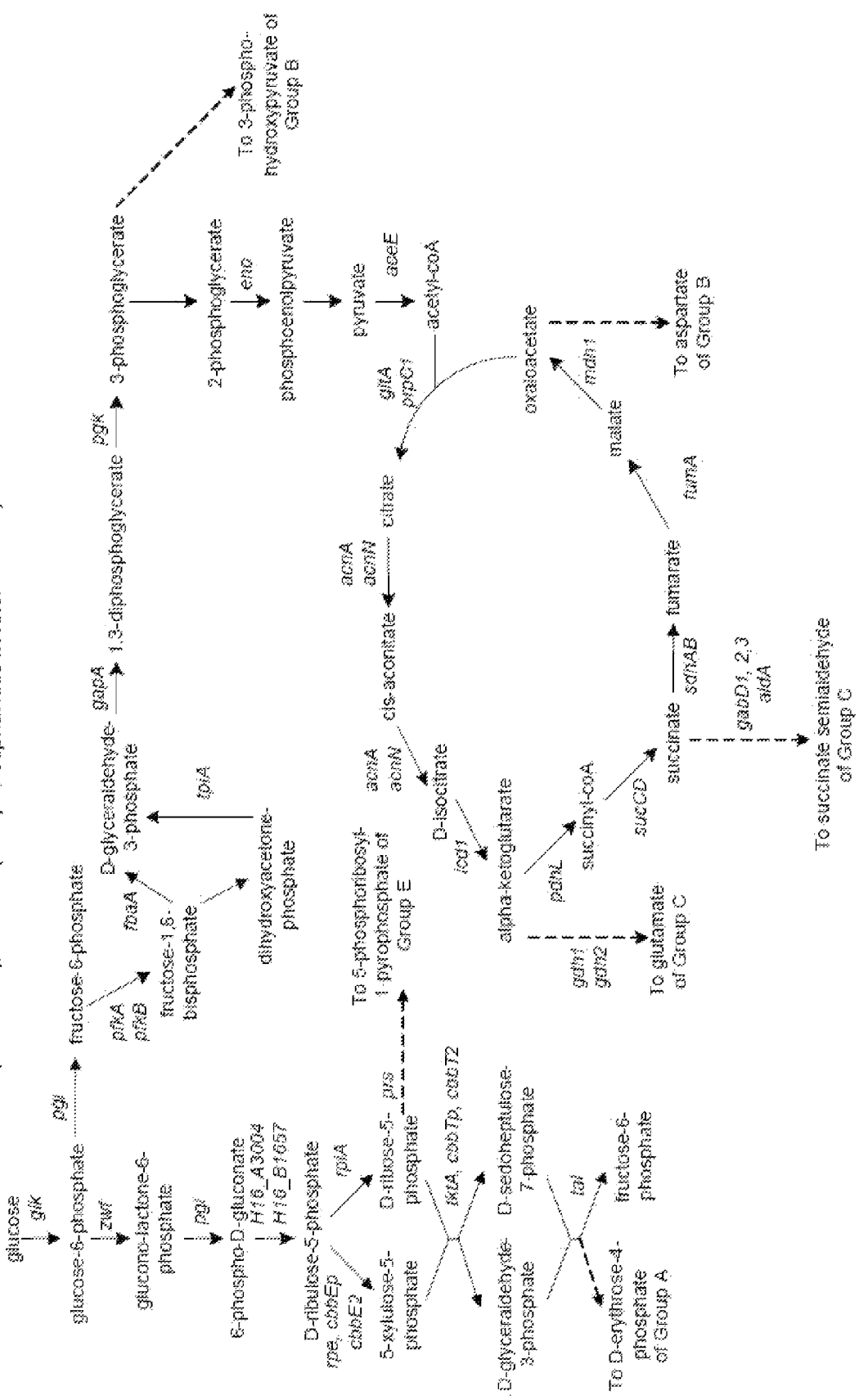
FIG. 9D (Continued), SHEET 2 (Group F, Cupriavidus necator 3HPTGC)

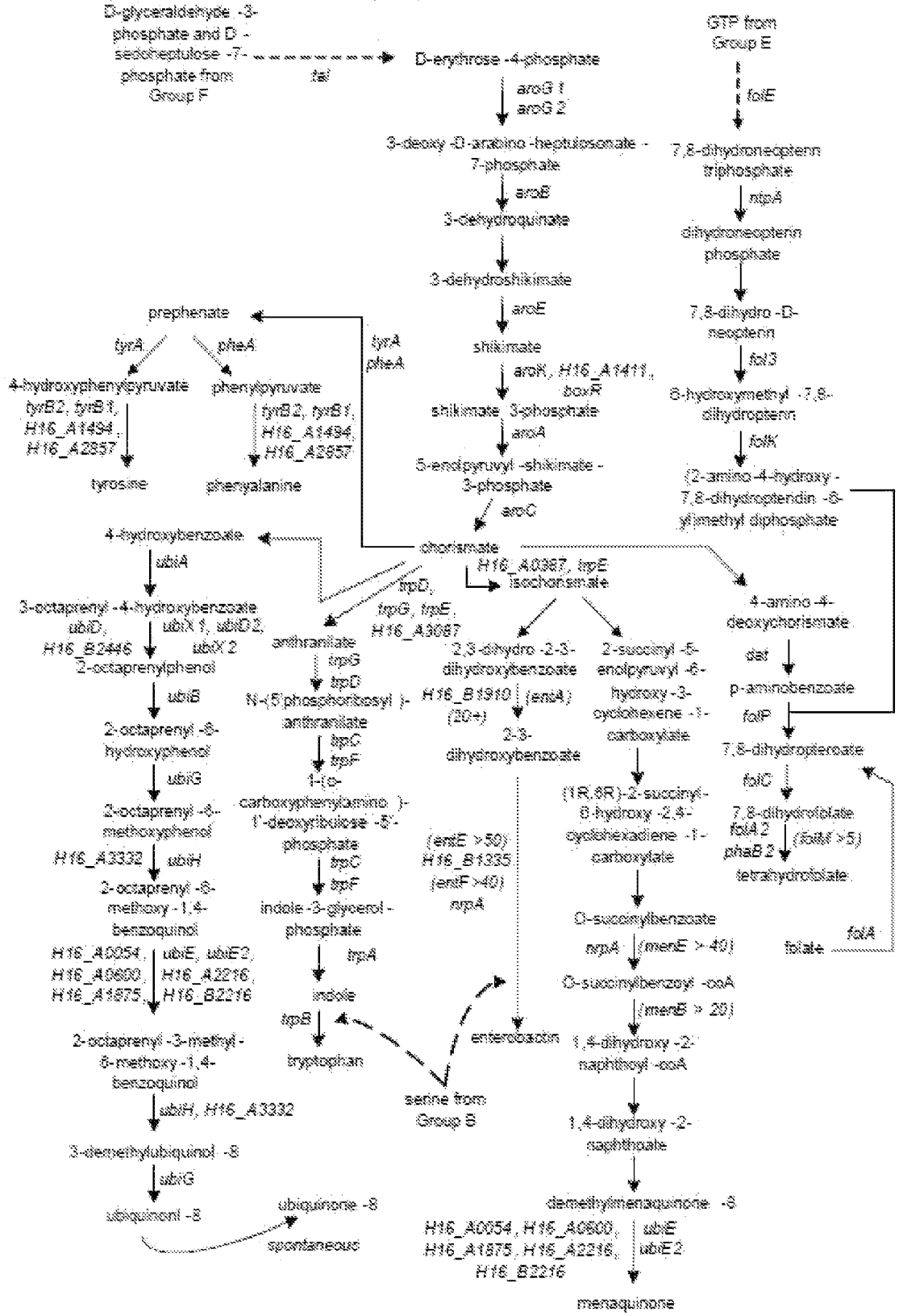
FIG. 9D (Continued), SHEET 3 (Group A, Cupriavidus necator 3HPTGC)

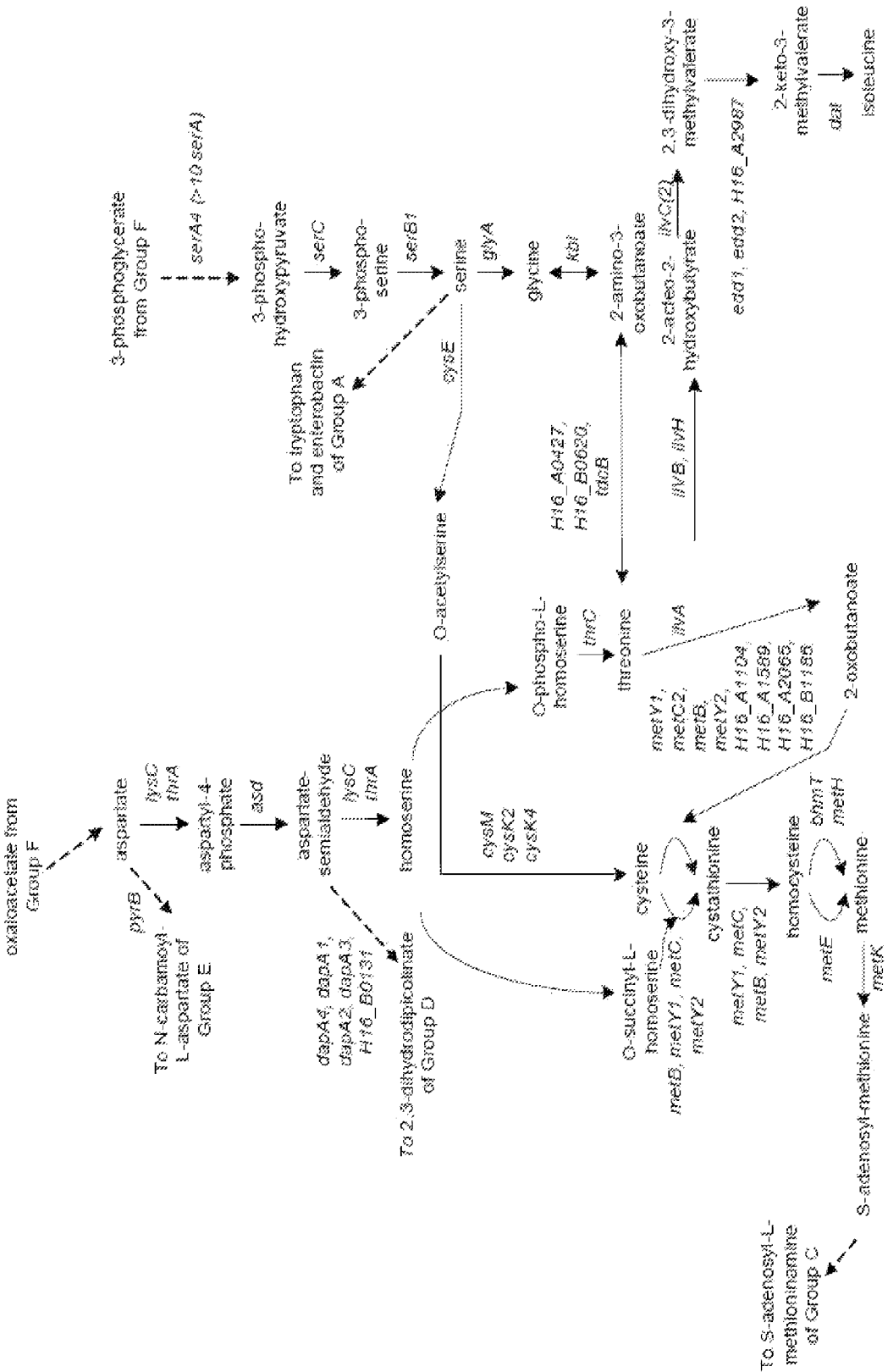
FIG. 9D (Continued), SHEET 4 (Group B, Cupriavidus necator 3HPTGC)

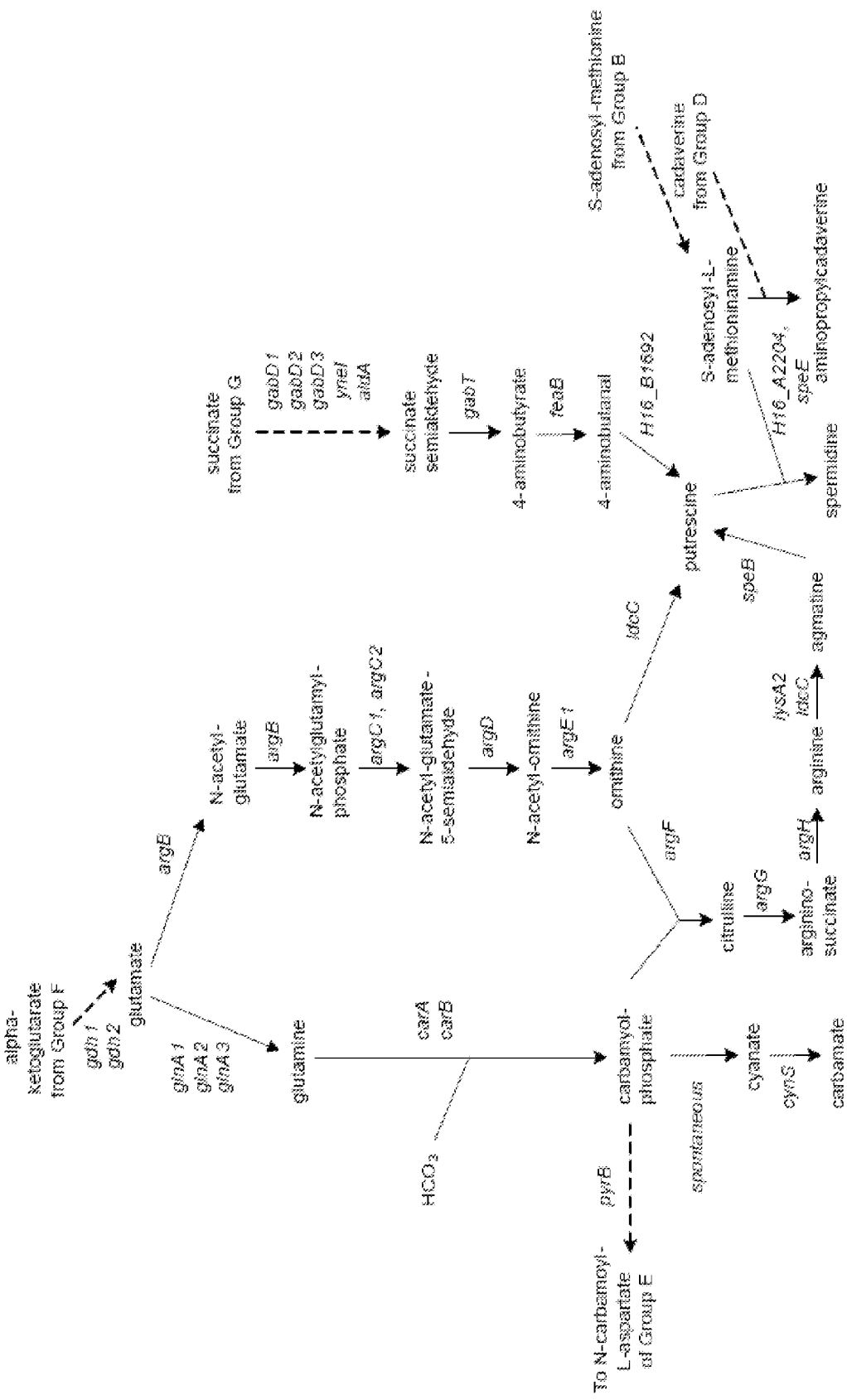
FIG. 9D (Continued), SHEET 5 (Group C, Cupriavidus necator 3HPTGC)

FIG. 9D (Continued), SHEET 6 (Group D, Cupriavidus necator 3HPTGC)
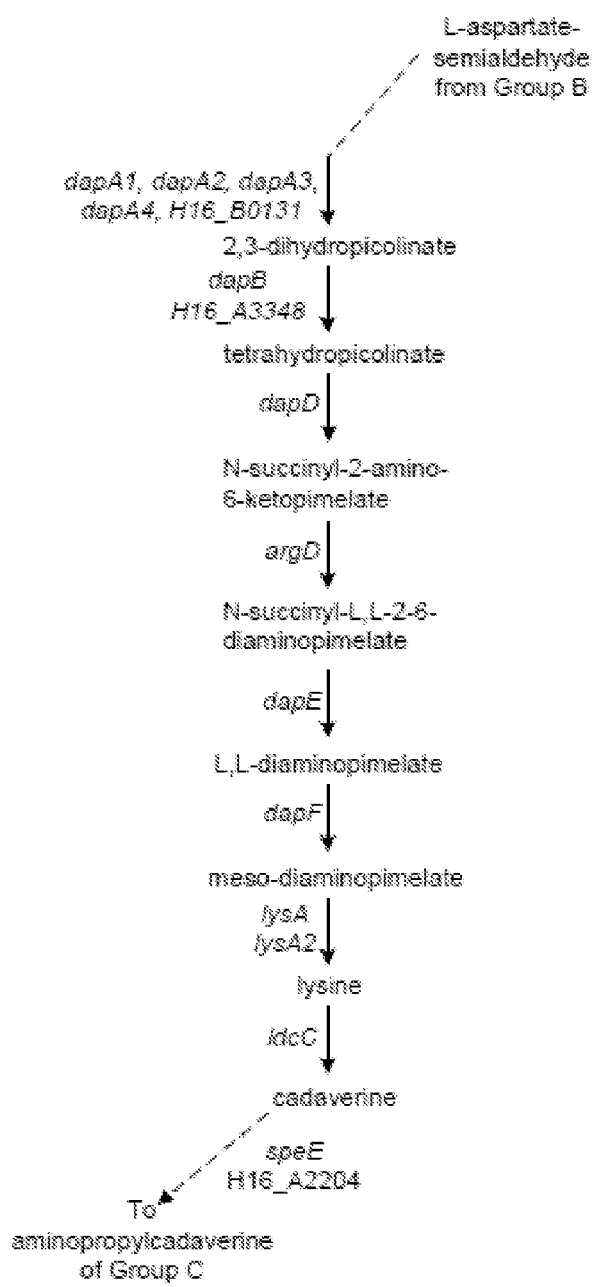

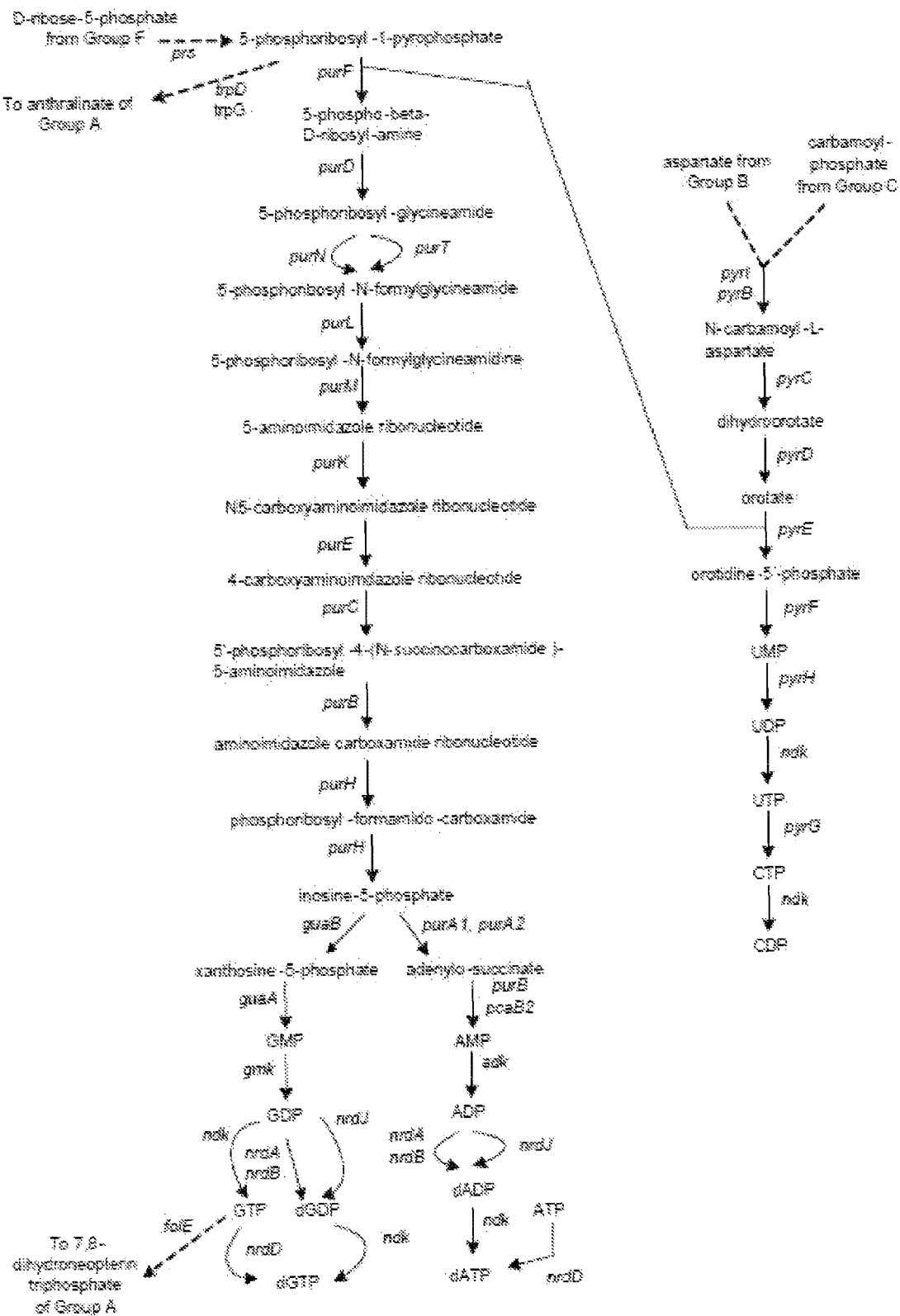
FIG. 9D (Continued), SHEET 7 (Group E, *Cupriavidus necator* 3HPTGC)

FIG. 14
A. Natural mixed acid fermentation in *E. coli*
B. Proposed 3-HP fermentation
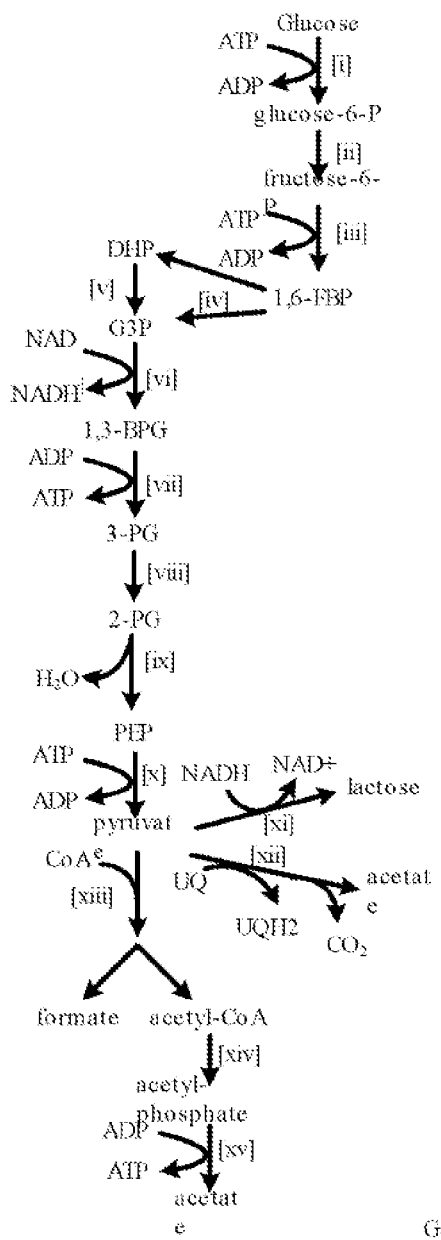
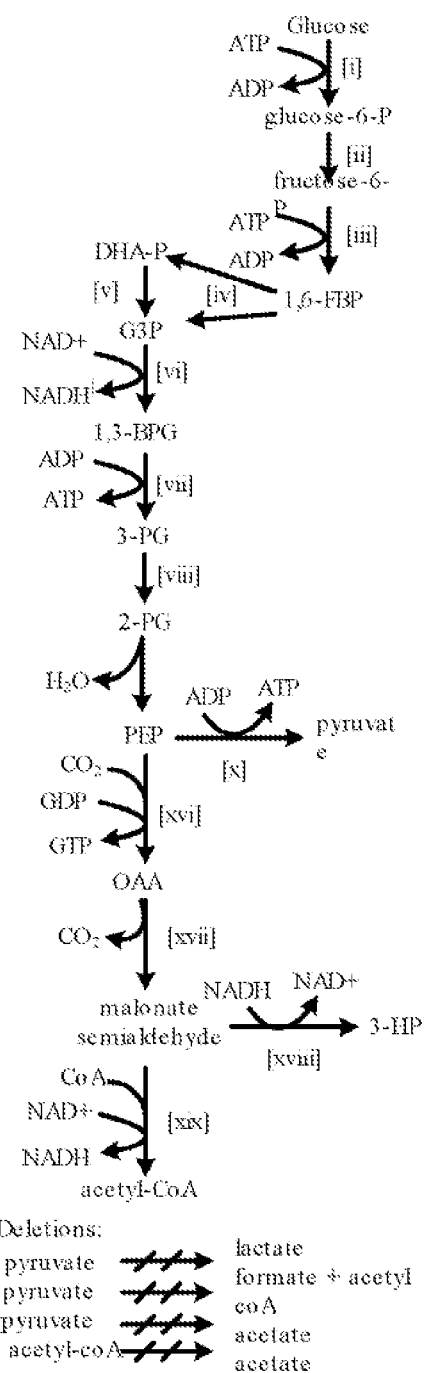

FIG. 18
| | MINIMAL MEDIA |
|---|---|
| E. coli AB354 | <br>NO GROWTH |
| E. coli AB354<br>+ gabT | <br>NO GROWTH |
| E. coli AB354<br>+ gabT<br>+ kdg | <br>NO GROWTH |
| E. coli AB354<br>+ gabT<br>+ MUTANT kdg<br>POOLS | 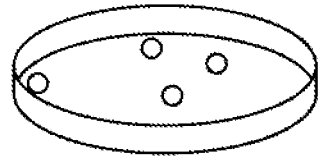<br>POSITIVE CLONES GROW |

US 8,883,464 B2

METHODS FOR PRODUCING 3-HYDROXYPROPIONIC ACID AND OTHER PRODUCTS

CROSS-REFERENCE TO RELATED APPLICATIONS

This is a national phase entry under 35 U.S.C. 371 of PCT Application No. PCT/US2010/050436, filed on Sep. 27, 2010, which claims priority from U.S. Provisional Application 61/246,141, filed Sep. 27, 2009, U.S. Provisional Application 61/298,844, filed Jan. 27, 2010, and U.S. Provisional Application 61/321,480, filed Apr. 6, 2010. The entire contents of each application are hereby incorporated by reference in their entirety.

FIELD OF THE INVENTION

This invention relates to metabolically engineered microorganisms, such as bacterial strains, in which there is an increased utilization of malonyl-CoA for production of a chemical product, which may include the chemical 3-hydroxypropionic acid (3-HP) and products made from 3-HP. The metabolically engineered microorganisms may be adapted to exhibit increased tolerance to 3-HP. Also, genetic modifications may be made to provide one or more 3-HP biosynthesis pathways such as in microorganisms comprising one or more genetic modifications of a complex identified as the 3-HP toleragenic complex.

SEQUENCE LISTING

The instant application contains a Sequence Listing which has been submitted in ASCII format via EFS-Web and is hereby incorporated by reference in its entirety. Said ASCII copy, created on May 2, 2013, is named 34246-744-831-SL.txt and is 2,177 Kilobytes in size.

BACKGROUND OF THE INVENTION

With increasing acceptance that petroleum hydrocarbon supplies are decreasing and their costs are ultimately increasing, interest has increased for developing and improving industrial microbial systems for production of chemicals and fuels. Such industrial microbial systems could completely or partially replace the use of petroleum hydrocarbons for production of certain chemicals.

Numerous chemicals are produced through such means, ranging from antibiotic and anti-malarial pharmaceutical products to fine chemicals to fuels such as ethanol. Commercial objectives for microbial fermentation include the increase of titer, production rate, and yield of a target chemical product. When the overall specific productivity in a fermentation event is elevated, this may positively affect yield in addition to production rate and other economic factors, such as capital costs.

One candidate chemical for such production is 3-hydroxypropionic acid ("3-HP", CAS No. 503-66-2), which may be converted to a number of basic building blocks for polymers used in a wide range of industrial and consumer products. Unfortunately, previous efforts to microbially synthesize 3-HP to achieve commercially viable titers have revealed that the microbes being used were inhibited by concentrations of 3-HP far below a determined commercially viable titer.

In spite of strong interest to improve microbial fermentation economics by improving yield and/or productivity for certain chemical products, there remains a need to increase net conversion in a fermentative microorganism cell to desired target chemical products employing commercially viable fermentation methods. More particularly, among problems remaining to be solved are how to improve specific productivity and volumetric productivity, such as to economically important levels, in modified microorganisms that are adapted to produce a chemical product having malonyl-CoA as a substrate in the microbial production pathway of that chemical product, such as 3-hydroxypropionic acid (3-HP).

SUMMARY OF THE INVENTION

According to one embodiment, the invention is directed to a method for producing an acrylic acid-based consumer product, said method comprising i) combining a carbon source and a microorganism cell culture to produce 3-hydroxypropionic acid, wherein a) said cell culture comprises an inhibitor of fatty acid synthase or said microorganism is genetically modified for reduced enzymatic activity in the organism's fatty acid synthase pathway; or b) wherein said microorganism is genetically modified for increased enzymatic activity in the organism's malonyl-CoA reductase (mcr) pathway by introduction of a heterologous nucleic acid sequence coding for a polypeptide having mono-functional malonyl-CoA reductase activity; or c) said 3-hydroxypropionic acid is produced at a specific productivity of greater than 0.05 grams per gram of microorganism cell on a dry weight basis per hour or at a volumetric productivity of greater than 0.50 grams per liter per hour; ii) converting the 3-hydroxypropionic acid to acrylic acid; and iii) processing the acrylic acid into a consumer product. In various aspects, the carbon source has a ratio of carbon-14 to carbon-12 of about $1.0 \times 10^{-14}$ or greater.

The carbon source according to the invention may be predominantly glucose, sucrose, fructose, dextrose, lactose, or a combination thereof. Alternatively, the carbon source is glycerol.

In certain embodiments, the cell culture comprises an inhibitor of fatty acid synthase or said microorganism is genetically modified for reduced enzymatic activity in the organism's fatty acid synthase pathway. For example, the inhibitor of a fatty acid synthase may be selected from the group consisting of thiolactomycin, triclosan, cerulenin, thienodiazaborine, isoniazid, and analogs thereof.

The microorganism of the invention may be genetically modified for increased enzymatic activity in the organism's malonyl-CoA reductase (mcr) pathway by introduction of a heterologous nucleic acid sequence coding for a polypeptide having mono-functional malonyl-CoA reductase activity. In various embodiments, the mono-functional malonyl-CoA reductase is NADPH-independent.

In various embodiments, the 3-hydroxypropionic acid is produced according to the invention at a specific productivity of greater than 0.05 grams per gram of microorganism cell on a dry weight basis per hour or at a volumetric productivity of greater than 0.05 grams per liter per hour.

Included within the invention are embodiments where the cell culture comprises a genetically modified microorganism. The genetically modified microorganism can be modified for a trait selected from reduced enzymatic activity in the organism's fatty acid synthase pathway, increased enzymatic activity in the organism's malonyl-CoA reductase pathway, increased tolerance to 3-hydroxypropionic acid, increased enzymatic activity in the organism's NADPH-dependent transhydrogenase pathway, increased intracellular bicarbonate levels, increased enzymatic activity in the organism's acetyl-CoA carboxylase pathway, and combinations thereof. For example, the genetically modified microorganism can be modified for reduced enzymatic activity in the organism's fatty acid synthase pathway. Alternatively, the reduced enzymatic activity is a reduction in enzymatic activity in an enzyme selected from the group consisting of beta-ketoacyl-ACP reductase, 3-hydroxyacyl-CoA dehydratase, enoyl-ACP reductase, and thioesterase. In various aspects, the reduced enzymatic activity in the organism's fatty acid synthase pathway occurs via introduction of a heterologous nucleic acid sequence coding for an inducible promoter operably linked to a sequence coding for a enzyme in the fatty acid synthase pathway or homolog thereof, or a heterologous nucleic acid sequence coding for an enzyme in the fatty acid synthase pathway or homolog thereof with reduced activity. In various aspects, the enzyme in the fatty acid synthase pathway or homolog thereof is a polypeptide with temperature-sensitive beta-ketoacyl-ACP or temperature-sensitive enoyl-ACP reductase activity. Variously, the genetically modified microorganism is modified for increased enzymatic activity in the organism's malonyl-CoA reductase pathway.

In certain embodiments, the increase in enymatic activity in the malonyl-CoA reductase (mcr) pathway occurs by introduction of a heterologous nucleic acid sequence coding for a polypeptide having bi-functional malonyl-CoA reductase enzymatic activity or mono-functional malonyl-CoA reductase activity. The heterologous nucleic acid sequence may be selected from a sequence having at least 70% homology with a sequence selected from SEQ ID NO. 780-789.

In various embodiments, the genetically modified microorganism is modified for increased tolerance to 3-hydroxypropionic acid. The increase in tolerance to 3-hydroxypropionic acid may occur in one or more components of the 3-HP toleragenic complex (3HPTGC) complex, or wherein said increase in tolerance to 3-hydroxypropionic acid results from providing at least one genetic modification of each of Group A and Group B of the 3HPTGC. The one or more components may be selected from CynS, CynT, AroG, SpeD, SpeE, SpeF, ThrA, Asd, CysM, IroK, IlvA, and homologs thereof. In various embodiments, the modification is a disruption of one or more 3HPTGC repressor genes. The repressor genes may be selected from tyrR, trpR, metJ, purR, lysR, nrdR, and homologs thereof.

Increased enzymatic activity in the organism's NADPH-dependent transhydrogenase pathway may occur by introduction of a heterologous nucleic acid sequence coding for a polypeptide having at least 70% homology with a sequence selected from SEQ ID NO. 776 or 778. In various embodiments, the increased intracellular bicarbonate levels occurs by introduction of a heterologous nucleic acid sequence coding for a polypeptide having cyanase and/or carbonic anhydrase activity. Heterologous nucleic acid sequence may be selected from a sequence having at least 70% homology with a sequence selected from SEQ ID NO. 337.

In various embodiments, an increased enzymatic activity in the organism's acetyl-CoA carboxylase pathway occurs by introduction of a heterologous nucleic acid sequence coding for a polypeptide having at least 70% homology with a sequence selected from SEQ ID NO. 768-775.

The genetically modified bacteria may be further modified to decrease activity of, lactate dehydrogenase, phosphate acetyltransferase, pyruvate oxidase, or pyruvate-formate lyase, and combinations thereof.

The method according to the invention may further comprise separating and/or purifying 3-hydroxypropionic acid from said cell culture by extraction of 3-hydroxypropionic acid from said culture in the presence of a tertiary amine. Variously, 3-hydroxypropionic acid is produced at a specific productivity of greater than 0.05 grams per gram of microorganism cell on a dry weight basis per hour or at a volumetric productivity of greater than 0.50 grams per liter per hour.

The method of the invention may include production of a consumer product, such as diapers, carpet, paint, adhesives, and acrylic glass. The invention includes biologically-produced 3-hydroxypropionic acid, where the 3-hydroxypropionic acid is produced according to the method of the invention. Such 3-hydroxypropionic acid may be essentially free of chemical catalyst, including a molybdenum and/or vanadium based catalyst. The 3-hydroxypropionic acid is produced according to the method of the invention may have a ratio of carbon-14 to carbon-12 of about $1.0 \times 10^{-14}$ or greater. In various aspects, the 3-hydroxypropionic acid contains less than about 10% carbon derived from petroleum. In addition, 3-hydroxypropionic acid according to the invention may contain a residual amount of organic material related to its method of production. In various embodiments, the 3-hydroxypropionic acid contains a residual amount of organic material in an amount between 1 and 1,000 parts per million of the 3-hydroxypropionic acid.

Acrylic acid and a polymer produced from acrylic acid, where such are produced according to the method of the invention, are also included within the invention. Products, including commercial and consumer products, obtained from the polymers are also encompassed. For example, diapers, carpet, paint, adhesives, and acrylic glass are encompassed.

In addition, the invention encompasses a system for bioproduction of acrylic acid according to claim 40, said system comprising: a tank for saccharification of biomass; a line for passing the product of saccharification to a fermentation tank optionally via a pre-fermentation tank; a fermentation tank suitable for microorganism cell culture; a line for discharging contents from the fermentation tank to an extraction and/or separation vessel; an extraction and/or separation vessel suitable for removal of 3-hydroxypropionic acid from cell culture waste; a line for transferring 3-hydroxypropionic acid to a dehydration vessel; and a dehydration vessel suitable for conversion of 3-hydroxypropionic acid to acrylic acid. In various embodiments, the system further comprises one or more pre-fermentation tanks, distillation columns, centrifuge vessels, back extraction columns, mixing vessels, or combinations thereof. In various embodiments, the system has a minimum production capacity of at least 1 ton acrylic acid per year.

Within the scope of the invention are genetically modified microorganism, wherein the microorganism is capable of producing 3-hydroxypropionate at a specific rate selected from the rates of greater than 0.05 g/gDCW-hr, 0.08 g/gDCW-hr, greater than 0.1 g/gDCW-hr, greater than 0.13 g/gDCW-hr, greater than 0.15 g/gDCW-hr, greater than 0.175 g/gDCW-hr, greater than 0.2 g/gDCW-hr, greater than 0.25 g/gDCW-hr, greater than 0.3 g/gDCW-hr, greater than 0.35 g/gDCW-hr, greater than 0.4 g/gDCW-hr, greater than 0.45 g/gDCW-hr, or greater than 0.5 g/gDCW-hr.

The genetically modified microorganism may comprise genetic modifications to increase malonyl-coA reductase activity and acetyl-coA carboxylase activity, and genetic modifications to reduce enoyl-ACP reductase activity, lactate dehydrogenase activity and acetate kinase activity. Variously, the microorganism comprises genetic modifications to increase malonyl-coA reductase activity and acetyl-coA carboxylase activity, and genetic modifications to reduce enoyl-ACP reductase activity, lactate dehydrogenase activity and acetylphosphate transferase activity. In addition, the microorganism may comprise genetic modifications to increase malonyl-coA reductase activity and acetyl-coA carboxylase activity, and genetic modifications to reduce enoyl-ACP reductase activity, lactate dehydrogenase activity, acetate kinase activity and acetylphosphate transferase activity. In various aspects, the microorganism comprises genetic modifications to increase malonyl-coA reductase activity and acetyl-coA carboxylase activity, and genetic modifications to reduce enoyl-ACP reductase activity, lactate dehydrogenase activity and pyruvate formate lyase activity. In various embodiments, the microorganism comprises genetic modifications to increase malonyl-coA reductase activity and acetyl-coA carboxylase activity, and genetic modifications to reduce enoyl-ACP reductase activity, lactate dehydrogenase activity and pyruvate oxidase activity. Also included are microorganisms comprising genetic modifications to increase malonyl-coA reductase activity and acetyl-coA carboxylase activity, and genetic modifications to reduce enoyl-ACP reductase activity, lactate dehydrogenase activity and methylglyoxal synthase activity. In addition, microorganisms according to the invention may comprise genetic modifications to increase malonyl-coA reductase activity and acetyl-coA carboxylase activity, and genetic modifications to increase β-ketoacyl-ACP synthase activity, and decrease lactate dehydrogenase activity and methylglyoxal synthase activity, and/or the microorganism may comprise genetic modifications to increase malonyl-coA reductase activity and acetyl-coA carboxylase activity, and genetic modifications to reduce enoyl-ACP reductase activity, guanosine 3'-diphosphate 5'-triphosphate synthase activity, and guanosine 3'-diphosphate 5'-diphosphate synthase activity. Also, in some microorganisms enoyl-CoA reductase, is reduced instead of or in addition to doing such for enoyl-ACP reductase activity.

In various embodiments, a further genetic modification has been made that increases NADH/NADPH transhydrogenase activity. For example, the transhydrogenase activity may be soluble, may be membrane bound, may have a further genetic modification that has been made that increases cyanase activity, may include a further genetic modification that increases carbonic anhydrase activity, and/or may include a further genetic modification that increases pyruvate dehydrogenase activity.

In various embodiments, a further genetic modification has been made that decreases guanosine 3'-diphosphate 5'-triphosphate synthase activity, and guanosine 3'-diphosphate 5'-diphosphate synthase activity. Also included is when a genetic modification has been made that increases the NADH/NAD+ ratio in an aerated environment. Further, a genetic modification may be made that decreases β-ketoacyl-ACP synthase activity, decreases 3-hydroxypropionate reductase activity, decreases NAD+ dependant 3-hydroxypropionate dehydrogenase activity, decreases NAD+ dependant 3-hydroxypropionate dehydrogenase activity, increases tolerance to 3-hydroxypropionic acid, increases activity of any enzyme in the 3-HP toleragenic complex, increases pyruvate dehydrogenase activity, increases cyanase activity, increases carbonic anhydrase activity, increases aspartate kinase activity, increases threonine dehydratase activity, increases 2-dehydro-3-deoxyphosphoheptonate aldolase activity, increases cysteine synthase activity, increases ribose-phosphate diphosphokinase activity, increases ribonucleoside-diphosphate reductase activity, increases L-cysteine desulfhydrase activity, increases lysine decarboxylase activity, increases homocysteine transmethylase activity, increases dihydrofolate reductase activity, increases N-acetylglutamylphosphate reductase activity, increases acetylglutamate kinase activity, increases argininosuccinate lyase activity, increases acetylornithine deacetylase activity, increases chorismate mutase activity, increases prephenate dehydratase activity, increases prephenate dehydrogenase activity, increases 2-dehydro-3-deoxyphosphoheptonate aldolase activity, and/or increases D-3-phosphoglycerate dehydrogenase activity.

In various embodiments, the invention includes a culture system comprising a carbon source in an aqueous medium and a genetically modified microorganism according to any one of claims 48-92, wherein said genetically modified organism is present in an amount selected from greater than 0.05 gDCW/L, 0.1 gDCW/L, greater than 1 gDCW/L, greater than 5 gDCW/L, greater than 10 gDCW/L, greater than 15 gDCW/L or greater than 20 gDCW/L, such as when the volume of the aqueous medium is selected from greater than 5 mL, greater than 100 mL, greater than 0.5 L, greater than 1 L, greater than 2 L, greater than 10 L, greater than 250 L, greater than 1000 L, greater than 10,000 L, greater than 50,000 L, greater than 100,000 L or greater than 200,000 L, and such as when the volume of the aqueous medium is greater than 250 L and contained within a steel vessel.

Variously, the carbon source for such culture systems is selected from dextrose, sucrose, a pentose, a polyol, a hexose, both a hexose and a pentose, and combinations thereof, the pH of the aqueous medium is less than 7.5, the culture system is aerated, such as at an oxygen transfer rate selected from i) greater than 5 mmole/L-hr of oxygen and less than 200 mmole/L-hr oxygen; ii) greater than 5 mmole/L-hr of oxygen and less than 100 mmole/L-hr oxygen; iii) greater than 5 mmole/L-hr of oxygen and less than 80 mmole/L-hr oxygen; and iv) greater than 5 mmole/L-hr of oxygen and less than 50 mmole/L-hr oxygen.

In various embodiments, the invention is an aqueous broth obtained from a culture system according to any one of claims 93-99, wherein said aqueous broth comprises i) a concentration of 3-hydroxypropionate selected from greater than 5 g/L, greater than 10 g/L, greater than 15 g/L, greater than 20 g/L, greater than 25 g/L, greater than 30 g/L, greater than 35 g/L, greater than 40 g/L, greater than 50 g/L, greater than 60 g/L, greater than 70 g/L, greater than 80 g/L, greater than 90 g/L, or greater than 100 g/L 3-hydroxypropionate; and ii) a concentration of 1,3-propanediol selected from less than 30 g/L; less than 20 g/L; less than 10 g/L; less than 5 g/L; less than 1 g/L; or less than 0.5 g/L. In some aspects, the aqueous broth comprises an amount of biomass selected from less than 20 gDCW/L biomass, less than 15 gDCW/L biomass, less than 10 gDCW/L biomass, less than 5 gDCW/L biomass or less than 1 gDCW/L biomass. Alternatively, the aqueous broth according to the invention is such that the 3-HP/succinate ratio (g3-HP/g succinate) is greater than 3, greater than 10 greater than 30, greater than 60, greater than 100, greater than 150 or greater than 200. In various aspects, the 3-HP/fumarate ratio (g3-HP/g fumarate) is greater than 3, greater than 10 greater than 30, greater than 60, greater than 100, greater than 150 or greater than 200, or the 3-HP/glycerol ratio (g3-HP/g glycerol) is greater than 3, greater than 10, greater than 30, greater than 60, greater than 100, greater than 150 or greater than 200, or the 3-HP/acetate ratio (g3-HP/g acetate) is greater than 1.5, greater than 3, greater than 10, greater than 30, greater than 60, greater than 100, greater than 150 or greater than 200, or the 3-HP/alanine ratio (g3-HP/g alanine) is greater than 3, greater than 10, greater than 30, greater than 60, greater than 100, greater than 150 or greater than 200, or the 3-HP/beta-alanine ratio (g3-HP/g beta-alanine) is greater than 1.5, greater than 3, greater than 10, greater than 30, greater than 60, greater than 100, greater than 150 or greater than 200, or the 3-HP/glutamate ratio (g3-HP/g glutamate) is greater than 3, greater than 10, greater than 30, greater than 60, greater than 100, greater than 150 or greater than 200, or the 3-HP/glutamine ratio (g3-HP/g glutamine) is greater than 3, greater than 10, greater than 30, greater than 60, greater than 100, greater than 150 or greater than 200, or the 3-HP/ 3-hydroxypropionaldehyde ratio (g3-HP/g 3-hydroxypropio-aldehyde) is greater than 1.5, greater than 3, greater than 10, greater than 30, greater than 60, greater than 100, greater than 150 or greater than 200, or the 3-HP/1,3-propanediol ratio (g3-HP/g 1,3-propanediol) is greater than 1.5, greater than 3, greater than 10, greater than 30, greater than 60, greater than 100, greater than 150 or greater than 200, and/or the 3-HP/ lactate ratio (g3-HP/g lactate) is greater than 3, greater than 10, greater than 30, greater than 60, greater than 100, greater than 150 or greater than 200.

BRIEF DESCRIPTION OF THE DRAWINGS

The novel features of the invention are set forth with particularity in the claims. A better understanding of the features and advantages of the present invention will be obtained by reference to the following detailed description that sets forth illustrative embodiments, in which the principles of the invention are utilized, and the accompanying drawings of which:

FIG. 3 provides an exemplary multiple sequence alignment, comparing carbonic anhydrase polypeptides (CLUSTAL 2.0.12 multiple sequence alignment of Carbonic Anhydrase Polypeptides).

FIG. 4A provides an exemplary sequence alignment: Comparison of DNA sequences of fabI$^{rs}$ (JP1111 (SEQ ID No.: 769)) and wildtype (BW25113 (SEQ ID No.:827)) *E. coli* fabI genes DNA mutation: C722T.

FIG. 4B provides an exemplary sequence alignment: Comparison of protein sequences of fabI$^{rs}$ (JP1111 (SEQ ID No.: 770) and wildtype (BW25113 (SEQ ID No.:828)) *E. coli* fabI genes Amino Acid-S241F.

FIG. 9A, sheets 1-7 is a multi-sheet depiction of portions of metabolic pathways, showing pathway products and enzymes, that together comprise the 3-HP toleragenic complex (3HPTGC) in *E. coli*. Sheet 1 provides a general schematic depiction of the arrangement of the remaining sheets.

FIG. 9B, sheets 1-7, provides a multi-sheet depiction of the 3HPTGC for *Bacillus subtilis*. Sheet 1 provides a general schematic depiction of the arrangement of the remaining sheets.

FIG. 9C, sheets 1-7, provides a multi-sheet depiction of the 3HPTGC for *Saccharomyces cerevisiae*. Sheet 1 provides a general schematic depiction of the arrangement of the remaining sheets.

FIG. 9D, sheets 1-7, provides a multi-sheet depiction of the 3HPTGC for *Cupriavidus necator* (previously, *Ralstonia eutropha*). Sheet 1 provides a general schematic depiction of the arrangement of the remaining sheets.

FIGS. 14A and B provide a schematic diagram of natural mixed fermentation pathways in *E. coli*.

FIG. 18 shows a proposed selection approach for kgd mutants.

Figure 1:
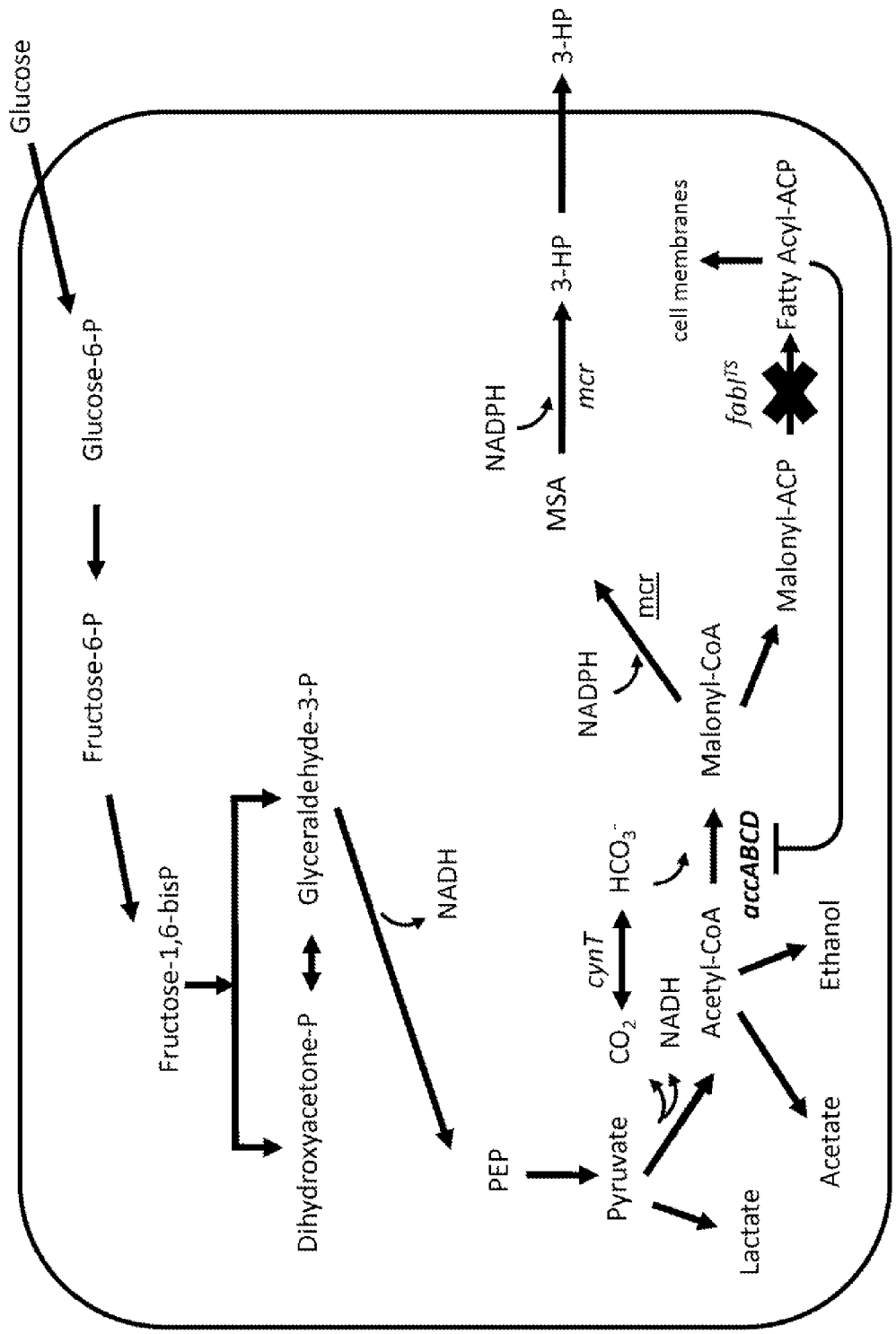
FIG. 1 depicts metabolic pathways of a microorganism related to aspects of the present invention, more particularly related to 3-HP production, with gene names of *E. coli* shown at certain enzymatic steps, the latter for example and not meant to be limiting.

Tables also are provided herein and are part of the specification.

DETAILED DESCRIPTION OF THE INVENTION

The present invention is related to various production methods and/or genetically modified microorganisms that have utility for fermentative production of various chemical products, to methods of making such chemical products that utilize populations of these microorganisms in vessels, and to systems for chemical production that employ these microorganisms and methods. Among the benefits of the present invention is increased specific productivity when such microorganisms produce a chemical product during a fermentation event or cycle. The present invention provides production techniques and/or genetically modified microorganisms to produce a chemical product of interest, such as 3-hydroxypropionic acid (3-HP) with one or more means for modulating conversion of malonyl-CoA to fatty acyl molecules (which thereafter may be converted to fatty acids, for example fatty acyl-ACP molecules), wherein the production pathway comprises an enzymatic conversion step that uses malonyl-CoA as a substrate. The means for modulating conversion of malonyl-CoA to fatty acyl molecules, such as fatty acyl-ACP molecules, is effective to balance carbon flow to microbial biomass with carbon flow to chemical product, and surprisingly affords achievement of elevated specific productivity rates.

As noted herein, various aspects of the present invention are directed to a microorganism cell comprises a metabolic pathway from malonyl-CoA to 3-HP, and means for modulating conversion of malonyl-CoA to fatty acyl molecules (which thereafter may be converted to fatty acids) also are provided. Then, when the means for modulating modulate to decrease such conversion, a proportionally greater number of malonyl-CoA molecules are 1) produced and/or 2) converted via the metabolic pathway from malonyl-CoA to 3-HP. In various embodiments, additional genetic modifications may be made, such as to 1) increase intracellular bicarbonate levels, such as by increasing carbonic anhydrase, 2) increase enzymatic activity of acetyl-CoA carboxylase, and NADPH-dependent transhydrogenase.

Unexpected increases in specific productivity by a population of a genetically modified microorganism may be achieved in methods and systems in which that microorganism has a microbial production pathway from malonyl-CoA to a selected chemical product as well as a reduction in the enzymatic activity of a selected enzyme of the microorganism's fatty acid synthase system (more particularly, its fatty acid elongation enzymes). In various embodiments, specific supplements to a bioreactor vessel comprising such microorganism population may also be provided to further improve the methods and systems.

Additionally, for one chemical product, 3-hydroxypropionic acid (3-HP), genetic modifications for production pathways are provided, and a toleragenic complex is described for which genetic modifications, and/or culture system modifications, may be made to increase microorganism tolerance to 3-HP. Moreover, genetic modifications to increase expression and/or enzymatic activity of carbonic anhydrase and/or cyanase may provide dual-functions to advantageously improve both 3-HP production and 3-HP tolerance.

Other additional genetic modifications are disclosed herein for various embodiments.

DEFINITIONS

As used in the specification and the claims, the singular forms "a," "an," and "the" include plural referents unless the context clearly dictates otherwise. Thus, for example, reference to an "expression vector" includes a single expression vector as well as a plurality of expression vectors, either the same (e.g., the same operon) or different; reference to "microorganism" includes a single microorganism as well as a plurality of microorganisms; and the like.

As used herein, dry cell weight (DCW) for E. coli strains is calculated as 0.33 times the measured $OD_{600}$ value, based on baseline DCW to $OD_{600}$ determinations.

As used herein, "reduced enzymatic activity," "reducing enzymatic activity," and the like is meant to indicate that a microorganism cell's, or an isolated enzyme, exhibits a lower level of activity than that measured in a comparable cell of the same species or its native enzyme. That is, enzymatic conversion of the indicated substrate(s) to indicated product(s) under known standard conditions for that enzyme is at least 10, at least 20, at least 30, at least 40, at least 50, at least 60, at least 70, at least 80, or at least 90 percent less than the enzymatic activity for the same biochemical conversion by a native (non-modified) enzyme under a standard specified condition. This term also can include elimination of that enzymatic activity. A cell having reduced enzymatic activity of an enzyme can be identified using any method known in the art. For example, enzyme activity assays can be used to identify cells having reduced enzyme activity. See, for example, Enzyme Nomenclature, Academic Press, Inc., New York 2007.

The term "heterologous DNA," "heterologous nucleic acid sequence," and the like as used herein refers to a nucleic acid sequence wherein at least one of the following is true: (a) the sequence of nucleic acids is foreign to (i.e., not naturally found in) a given host microorganism; (b) the sequence may be naturally found in a given host microorganism, but in an unnatural (e.g., greater than expected) amount; or (c) the sequence of nucleic acids comprises two or more subsequences that are not found in the same relationship to each other in nature. For example, regarding instance (c), a heterologous nucleic acid sequence that is recombinantly produced will have two or more sequences from unrelated genes arranged to make a new functional nucleic acid.

The term "heterologous" is intended to include the term "exogenous" as the latter term is generally used in the art. With reference to the host microorganism's genome prior to the introduction of a heterologous nucleic acid sequence, the nucleic acid sequence that codes for the enzyme is heterologous (whether or not the heterologous nucleic acid sequence is introduced into that genome).

As used herein, the term "gene disruption," or grammatical equivalents thereof (and including "to disrupt enzymatic function," "disruption of enzymatic function," and the like), is intended to mean a genetic modification to a microorganism that renders the encoded gene product as having a reduced polypeptide activity compared with polypeptide activity in or from a microorganism cell not so modified. The genetic modification can be, for example, deletion of the entire gene, deletion or other modification of a regulatory sequence required for transcription or translation, deletion of a portion of the gene which results in a truncated gene product (e.g., enzyme) or by any of various mutation strategies that reduces activity (including to no detectable activity level) the encoded gene product. A disruption may broadly include a deletion of all or part of the nucleic acid sequence encoding the enzyme, and also includes, but is not limited to other types of genetic modifications, e.g., introduction of stop codons, frame shift mutations, introduction or removal of portions of the gene, and introduction of a degradation signal, those genetic modifications affecting mRNA transcription levels and/or stability, and altering the promoter or repressor upstream of the gene encoding the enzyme.

In various contexts, a gene disruption is taken to mean any genetic modification to the DNA, mRNA encoded from the DNA, and the corresponding amino acid sequence that results in reduced polypeptide activity. Many different methods can be used to make a cell having reduced polypeptide activity. For example, a cell can be engineered to have a disrupted regulatory sequence or polypeptide-encoding sequence using common mutagenesis or knock-out technology. See, e.g., *Methods in Yeast Genetics* (1997 edition), Adams et al., Cold Spring Harbor Press (1998). One particularly useful method of gene disruption is complete gene deletion because it reduces or eliminates the occurrence of genetic reversions in the genetically modified microorganisms of the invention. Accordingly, a disruption of a gene whose product is an enzyme thereby disrupts enzymatic function. Alternatively, antisense technology can be used to reduce the activity of a particular polypeptide. For example, a cell can be engineered to contain a cDNA that encodes an antisense molecule that prevents a polypeptide from being translated. Further, gene silencing can be used to reduce the activity of a particular polypeptide.

The term "antisense molecule" as used herein encompasses any nucleic acid molecule or nucleic acid analog (e.g., peptide nucleic acids) that contains a sequence that corresponds to the coding strand of an endogenous polypeptide. An antisense molecule also can have flanking sequences (e.g., regulatory sequences). Thus, antisense molecules can be ribozymes or antisense oligonucleotides.

As used herein, a ribozyme can have any general structure including, without limitation, hairpin, hammerhead, or axhead structures, provided the molecule cleaves RNA.

The term "reduction" or "to reduce" when used in such phrase and its grammatical equivalents are intended to encompass a complete elimination of such conversion(s).

Bio-production, as used herein, may be aerobic, microaerobic, or anaerobic.

As used herein, the language "sufficiently homologous" refers to proteins or portions thereof that have amino acid sequences that include a minimum number of identical or equivalent amino acid residues when compared to an amino acid sequence of the amino acid sequences provided in this application (including the SEQ ID Nos./sequence listings) such that the protein or portion thereof is able to achieve the respective enzymatic reaction and/or other function. To determine whether a particular protein or portion thereof is sufficiently homologous may be determined by an assay of enzymatic activity, such as those commonly known in the art.

Descriptions and methods for sequence identity and homology are intended to be exemplary and it is recognized that these concepts are well-understood in the art. Further, it is appreciated that nucleic acid sequences may be varied and still encode an enzyme or other polypeptide exhibiting a desired functionality, and such variations are within the scope of the present invention.

Further to nucleic acid sequences, "hybridization" refers to the process in which two single-stranded polynucleotides bind non-covalently to form a stable double-stranded polynucleotide. The term "hybridization" may also refer to triple-stranded hybridization. The resulting (usually) double-stranded polynucleotide is a "hybrid" or "duplex." "Hybridization conditions" will typically include salt concentrations of less than about 1M, more usually less than about 500 mM and less than about 200 mM. Hybridization temperatures can be as low as 5° C., but are typically greater than 22° C., more typically greater than about 30° C., and often are in excess of about 37° C. Hybridizations are usually performed under stringent conditions, i.e. conditions under which a probe will hybridize to its target subsequence. Stringent conditions are sequence-dependent and are different in different circumstances. Longer fragments may require higher hybridization temperatures for specific hybridization. As other factors may affect the stringency of hybridization, including base composition and length of the complementary strands, presence of organic solvents and extent of base mismatching, the combination of parameters is more important than the absolute measure of any one alone. Generally, stringent conditions are selected to be about 5° C. lower than the $T_m$ for the specific sequence at a defined ionic strength and pH. Exemplary stringent conditions include salt concentration of at least 0.01 M to no more than 1 M Na ion concentration (or other salts) at a pH 7.0 to 8.3 and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations. For stringent conditions, see for example, Sambrook and Russell and Anderson "Nucleic Acid Hybridization" 1$^{st}$ Ed., BIOS Scientific Publishers Limited (1999), which are hereby incorporated by reference for hybridization protocols. "Hybridizing specifically to" or "specifically hybridizing to" or like expressions refer to the binding, duplexing, or hybridizing of a molecule substantially to or only to a particular nucleotide sequence or sequences under stringent conditions when that sequence is present in a complex mixture (e.g., total cellular) DNA or RNA.

The term "identified enzymatic functional variant" means a polypeptide that is determined to possess an enzymatic activity and specificity of an enzyme of interest but which has an amino acid sequence different from such enzyme of interest. A corresponding "variant nucleic acid sequence" may be constructed that is determined to encode such an identified enzymatic functional variant. For a particular purpose, such as increased tolerance to 3-HP via genetic modification to increase enzymatic conversion at one or more of the enzymatic conversion steps of the 3HPTGC in a microorganism, one or more genetic modifications may be made to provide one or more heterologous nucleic acid sequence(s) that encode one or more identified 3HPTGC enzymatic functional variant(s). That is, each such nucleic acid sequence encodes a polypeptide that is not exactly the known polypeptide of an enzyme of the 3HPTGC, but which nonetheless is shown to exhibit enzymatic activity of such enzyme. Such nucleic acid sequence, and the polypeptide it encodes, may not fall within a specified limit of homology or identity yet by its provision in a cell nonetheless provide for a desired enzymatic activity and specificity. The ability to obtain such variant nucleic acid sequences and identified enzymatic functional variants is supported by recent advances in the states of the art in bioinformatics and protein engineering and design, including advances in computational, predictive and high-throughput methodologies. Functional variants more generally include enzymatic functional variants, and the nucleic acids sequences that encode them, as well as variants of non-enzymatic polypeptides, wherein the variant exhibits the function of the original (target) sequence.

The use of the phrase "segment of interest" is meant to include both a gene and any other nucleic acid sequence segment of interest. One example of a method used to obtain a segment of interest is to acquire a culture of a microorganism, where that microorganism's genome includes the gene or nucleic acid sequence segment of interest.

When the genetic modification of a gene product, i.e., an enzyme, is referred to herein, including the claims, it is understood that the genetic modification is of a nucleic acid sequence, such as or including the gene, that normally encodes the stated gene product, i.e., the enzyme.

In some embodiments a truncated respective polypeptide has at least about 90% of the full length of a polypeptide encoded by a nucleic acid sequence encoding the respective native enzyme, and more particularly at least 95% of the full length of a polypeptide encoded by a nucleic acid sequence encoding the respective native enzyme. By a polypeptide having an amino acid sequence at least, for example, 95% "identical" to a reference amino acid sequence of a polypeptide is intended that the amino acid sequence of the claimed polypeptide is identical to the reference sequence except that the claimed polypeptide sequence can include up to five amino acid alterations per each 100 amino acids of the reference amino acid of the polypeptide. In other words, to obtain a polypeptide having an amino acid sequence at least 95% identical to a reference amino acid sequence, up to 5% of the amino acid residues in the reference sequence can be deleted or substituted with another amino acid, or a number of amino acids up to 5% of the total amino acid residues in the reference sequence can be inserted into the reference sequence. These alterations of the reference sequence can occur at the amino or carboxy terminal positions of the reference amino acid sequence or anywhere between those terminal positions, interspersed either individually among residues in the reference sequence or in one or more contiguous groups within the reference sequence. In other embodiments truncation may be more substantial, as described elsewhere herein.

Species and other phylogenic identifications are according to the classification known to a person skilled in the art of microbiology.

Where methods and steps described herein indicate certain events occurring in certain order, those of ordinary skill in the art will recognize that the ordering of certain steps may be modified and that such modifications are in accordance with the variations of the invention. Additionally, certain steps may be performed concurrently in a parallel process when possible, as well as performed sequentially.

Prophetic examples provided herein are meant to be broadly exemplary and not limiting in any way. This applies to the examples regarding separation and purification of 3-HP, and conversions of 3-HP to downstream compounds, since there are numerous possible approaches to such steps and conversions, including those disclosed in references recited and incorporated herein.

The meaning of abbreviations is as follows: "C" means Celsius or degrees Celsius, as is clear from its usage, DCW means dry cell weight, "s" means second(s), "min" means minute(s), "h," "hr," or "hrs" means hour(s), "psi" means pounds per square inch, "nm" means nanometers, "d" means day(s), "µL," or "uL" or "ul" means microliter(s), "mL" means milliliter(s), "L" means liter(s), "mm" means millimeter(s), "nm" means nanometers, "mM" means millimolar, "µM" or "uM" means micromolar, "M" means molar, "mmol" means millimole(s), "µmol" or "uMol" means micromole(s)", "g" means gram(s), "µg" or "ug" means microgram(s) and "ng" means nanogram(s), "PCR" means polymerase chain reaction, "OD" means optical density, "$OD_{600}$" means the optical density measured at a photon wavelength of 600 nm, "kDa" means kilodaltons, "g" means the gravitation constant, "bp" means base pair(s), "kbp" means kilobase pair(s), "% w/v" means weight/volume percent, "% v/v" means volume/volume percent, "IPTG" means isopropyl-µ-D-thiogalactopyranoiside, "RBS" means ribosome binding site, "rpm" means revolutions per minute, "HPLC" means high performance liquid chromatography, and "GC" means gas chromatography. As disclosed herein, "3-HP" means 3-hydroxypropionic acid and "3HPTGC" means the 3-HP toleragenic complex. Also, 10^5 and the like are taken to mean $10^5$ and the like.

I. Carbon Sources

Bio-production media, which is used in the present invention with recombinant microorganisms having a biosynthetic pathway for 3-HP, must contain suitable carbon sources or substrates for the intended metabolic pathways. Suitable substrates may include, but are not limited to, monosaccharides such as glucose and fructose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate may also be one-carbon substrates such as carbon dioxide, carbon monoxide, or methanol for which metabolic conversion into key biochemical intermediates has been demonstrated. In addition to one and two carbon substrates methylotrophic organisms are also known to utilize a number of other carbon containing compounds such as methylamine, glucosamine and a variety of amino acids for metabolic activity.

Although it is contemplated that all of the above mentioned carbon substrates and mixtures thereof are suitable in the present invention as a carbon source, common carbon substrates used as carbon sources are glucose, fructose, and sucrose, as well as mixtures of any of these sugars. Other suitable substrates include xylose, arabinose, other cellulose-based C-5 sugars, high-fructose corn syrup, and various other sugars and sugar mixtures as are available commercially. Sucrose may be obtained from feedstocks such as sugar cane, sugar beets, cassava, bananas or other fruit, and sweet sorghum. Glucose and dextrose may be obtained through saccharification of starch based feedstocks including grains such as corn, wheat, rye, barley, and oats. Also, in some embodiments all or a portion of the carbon source may be glycerol. Alternatively, glycerol may be excluded as an added carbon source.

In one embodiment, the carbon source is selected from glucose, fructose, sucrose, dextrose, lactose, glycerol, and mixtures thereof. Variously, the amount of these components in the carbon source may be greater than about 50%, greater than about 60%, greater than about 70%, greater than about 80%, greater than about 90%, or more, up to 100% or essentially 100% of the carbon source.

In addition, methylotrophic organisms are known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., Microb. Growth C1 Compd. (Int. Symp.), 7th (1993), 415-32. Editor(s): Murrell, J. Collin; Kelly, Don P. Publisher: Intercept, Andover, UK). Similarly, various species of *Candida* will metabolize alanine or oleic acid (Sulter et al., Arch. Microbiol. 153:485-489 (1990)). Hence it is contemplated that the source of carbon utilized in embodiments of the present invention may encompass a wide variety of carbon-containing substrates.

In addition, fermentable sugars may be obtained from cellulosic and lignocellulosic biomass through processes of pretreatment and saccharification, as described, for example, in U.S. Patent Publication No. 2007/0031918A1, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass could comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers and animal manure. Any such biomass may be used in a bio-production method or system to provide a carbon source. Various approaches to breaking down cellulosic biomass to mixtures of more available and utilizable carbon molecules, including sugars, include: heating in the presence of concentrated or dilute acid (e.g., <1% sulfuric acid); treating with ammonia; treatment with ionic salts; enzymatic degradation; and combinations of these. These methods normally follow mechanical separation and milling, and are followed by appropriate separation processes.

In various embodiments, any of a wide range of sugars, including, but not limited to sucrose, glucose, xylose, cellulose or hemicellulose, are provided to a microorganism, such as in an industrial system comprising a reactor vessel in which a defined media (such as a minimal salts media including but not limited to M9 minimal media, potassium sulfate minimal media, yeast synthetic minimal media and many others or variations of these), an inoculum of a microorganism providing one or more of the 3-HP biosynthetic pathway alternatives, and the a carbon source may be combined. The carbon source enters the cell and is cataboliized by well-known and common metabolic pathways to yield common metabolic intermediates, including phosphoenolpyruvate (PEP). (See Molecular Biology of the Cell, 3rd Ed., B. Alberts et al. Garland Publishing, New York, 1994, pp. 42-45, 66-74, incorporated by reference for the teachings of basic metabolic catabolic pathways for sugars; Principles of Biochemistry, 3rd Ed., D. L. Nelson & M. M. Cox, Worth Publishers, New York, 2000, pp 527-658, incorporated by reference for the teachings of major metabolic pathways; and Biochemistry, 4th Ed., L. Stryer, W. H. Freeman and Co., New York, 1995, pp. 463-650, also incorporated by reference for the teachings of major metabolic pathways.)

Bio-based carbon can be distinguished from petroleum-based carbon according to a variety of methods, including without limitation ASTM D6866, or various other techniques. For example, carbon-14 and carbon-12 ratios differ in bio-based carbon sources versus petroleum-based sources, where higher carbon-14 ratios are found in bio-based carbon sources. In various embodiments, the carbon source is not petroleum-based, or is not predominantly petroleum based. In various embodiments, the carbon source is greater than about 50% non-petroleum based, greater than about 60% non-petroleum based, greater than about 70% non-petroleum based, greater than about 80% non-petroleum based, greater than about 90% non-petroleum based, or more. In various embodiments, the carbon source has a carbon-14 to carbon-12 ratio of about $1.0 \times 10^{-14}$ or greater.

Various components may be excluded from the carbon source. For example, in some embodiments, acrylic acid, 1,4-butanediol, and/or glycerol are excluded or essentially excluded from the carbon source. As such, the carbon source according to some embodiments of the invention may be less than about 50% glycerol, less than about 40% glycerol, less than about 30% glycerol, less than about 20% glycerol, less than about 10% glycerol, less than about 5% glycerol, less than about 1% glycerol, or less. For example, the carbon source may be essentially glycerol-free. By essentially glycerol-free is meant that any glycerol that may be present in a residual amount does not contribute substantially to the production of the target chemical compound.

II. Microorganisms

Features as described and claimed herein may be provided in a microorganism selected from the listing herein, or another suitable microorganism, that also comprises one or more natural, introduced, or enhanced 3-HP bio-production pathways. Thus, in some embodiments the microorganism comprises an endogenous 3-HP production pathway (which may, in some such embodiments, be enhanced), whereas in other embodiments the microorganism does not comprise an endogenous 3-HP production pathway.

Varieties of these genetically modified microorganisms may comprise genetic modifications and/or other system alterations as may be described in other patent applications of one or more of the present inventor(s) and/or subject to assignment to the owner of the present patent application.

The examples describe specific modifications and evaluations to certain bacterial and yeast microorganisms. The scope of the invention is not meant to be limited to such species, but to be generally applicable to a wide range of suitable microorganisms. Generally, a microorganism used for the present invention may be selected from bacteria, cyanobacteria, filamentous fungi and yeasts.

For some embodiments, microbial hosts initially selected for 3-HP toleragenic bio-production should also utilize sugars including glucose at a high rate. Most microbes are capable of utilizing carbohydrates. However, certain environmental microbes cannot utilize carbohydrates to high efficiency, and therefore would not be suitable hosts for such embodiments that are intended for glucose or other carbohydrates as the principal added carbon source.

As the genomes of various species become known, the present invention easily may be applied to an ever-increasing range of suitable microorganisms. Further, given the relatively low cost of genetic sequencing, the genetic sequence of a species of interest may readily be determined to make application of aspects of the present invention more readily obtainable (based on the ease of application of genetic modifications to an organism having a known genomic sequence).

More particularly, based on the various criteria described herein, suitable microbial hosts for the bio-production of 3-HP that comprise tolerance aspects provided herein generally may include, but are not limited to, any gram negative organisms, more particularly a member of the family Enterobacteriaceae, such as *E. coli*, or *Oligotropha carboxidovorans*, or *Pseudomononas* sp.; any gram positive microorganism, for example *Bacillus subtilis*, *Lactobaccilus* sp. or *Lactococcus* sp.; a yeast, for example *Saccharomyces cerevisiae*, *Pichia pastoris* or *Pichia stipitis*; and other groups or microbial species. More particularly, suitable microbial hosts for the bio-production of 3-HP generally include, but are not limited to, members of the genera *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula* and *Saccharomyces*. Hosts that may be particularly of interest include: *Oligotropha carboxidovorans* (such as strain OM5), *Escherichia coli, Alcaligenes eutrophus* (*Cupriavidus necator*), *Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis* and *Saccharomyces cerevisiae*.

More particularly, suitable microbial hosts for the bio-production of 3-HP generally include, but are not limited to, members of the genera *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula* and *Saccharomyces*.

Hosts that may be particularly of interest include: *Oligotropha carboxidovorans* (such as strain $OM5^T$), *Escherichia coli, Alcaligenes eutrophus* (*Cupriavidus necator*), *Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis* and *Saccharomyces cerevisiae*. Also, any of the known strains of these species may be utilized as a starting microorganism, as may any of the following species including respective strains thereof—*Cupria-* vidus basilensis, Cupriavidus campinensis, Cupriavidus gilardi, Cupriavidus laharsis, Cupriavidus metallidurans, Cupriavidus oxalaticus, Cupriavidus pauculus, Cupriavidus pinatubonensis, Cupriavidus respiraculi, and Cupriavidus taiwanensis.

In some embodiments, the recombinant microorganism is a gram-negative bacterium. In some embodiments, the recombinant microorganism is selected from the genera Zymomonas, Escherichia, Pseudomonas, Alcaligenes, and Klebsiella. In some embodiments, the recombinant microorganism is selected from the species Escherichia coli, Cupriavidus necator, Oligotropha carboxidovorans, and Pseudomonas putida. In some embodiments, the recombinant microorganism is an E. coli strain.

In some embodiments, the recombinant microorganism is a gram-positive bacterium. In some embodiments, the recombinant microorganism is selected from the genera Clostridium, Salmonella, Rhodococcus, Bacillus, Lactobacillus, Enterococcus, Paenibacillus, Arthrobacter, Corynebacterium, and Brevibacterium. In some embodiments, the recombinant microorganism is selected from the species Bacillus licheniformis, Paenibacillus macerans, Rhodococcus erythropolis, Lactobacillus plantarum, Enterococcus faecium, Enterococcus gallinarium, Enterococcus faecalis, and Bacillus subtilis. In particular embodiments, the recombinant microorganism is a B. subtilis strain.

In some embodiments, the recombinant microorganism is a yeast. In some embodiments, the recombinant microorganism is selected from the genera Pichia, Candida, Hansenula and Saccharomyces. In particular embodiments, the recombinant microorganism is Saccharomyces cerevisiae.

It is further appreciated, in view of the disclosure, that any of the above microorganisms may be used for production of chemical products other than 3-HP.

The ability to genetically modify the host is essential for the production of any recombinant microorganism. The mode of gene transfer technology may be by electroporation, conjugation, transduction or natural transformation. A broad range of host conjugative plasmids and drug resistance markers are available. The cloning vectors are tailored to the host organisms based on the nature of antibiotic resistance markers that can function in that host.

III. Media and Culture Conditions

In addition to an appropriate carbon source, such as selected from one of the herein-disclosed types, bio-production media must contain suitable minerals, salts, cofactors, buffers and other components, known to those skilled in the art, suitable for the growth of the cultures and promotion of the enzymatic pathway necessary for 3-HP production, or other products made under the present invention.

Another aspect of the invention regards media and culture conditions that comprise genetically modified microorganisms of the invention and optionally supplements.

Typically cells are grown at a temperature in the range of about 25° C. to about 40° C. in an appropriate medium, as well as up to 70° C. for thermophilic microorganisms. Suitable growth media in the present invention are common commercially prepared media such as Luria Bertani (LB) broth, M9 minimal media, Sabouraud Dextrose (SD) broth, Yeast medium (YM) broth, (Ymin) yeast synthetic minimal media, and minimal media as described herein, such as M9 minimal media. Other defined or synthetic growth media may also be used, and the appropriate medium for growth of the particular microorganism will be known by one skilled in the art of microbiology or bio-production science. In various embodiments a minimal media may be developed and used that does not comprise, or that has a low level of addition of various components, for example less than 10, 5, 2 or 1 g/L of a complex nitrogen source including but not limited to yeast extract, peptone, tryptone, soy flour, corn steep liquor, or casein. These minimal medias may also have limited supplementation of vitamin mixtures including biotin, vitamin B12 and derivatives of vitamin B12, thiamin, pantothenate and other vitamins. Minimal medias may also have limited simple inorganic nutrient sources containing less than 28, 17, or 2.5 mM phosphate, less than 25 or 4 mM sulfate, and less than 130 or 50 mM total nitrogen.

Bio-production media, which is used in embodiments of the present invention with genetically modified microorganisms, must contain suitable carbon substrates for the intended metabolic pathways. As described hereinbefore, suitable carbon substrates include carbon monoxide, carbon dioxide, and various monomeric and oligomeric sugars.

Suitable pH ranges for the bio-production are between pH 3.0 to pH 10.0, where pH 6.0 to pH 8.0 is a typical pH range for the initial condition. However, the actual culture conditions for a particular embodiment are not meant to be limited by these pH ranges.

Bio-productions may be performed under aerobic, microaerobic, or anaerobic conditions, with or without agitation.

The amount of 3-HP or other product(s) produced in a bio-production media generally can be determined using a number of methods known in the art, for example, high performance liquid chromatography (HPLC), gas chromatography (GC), or GC/Mass Spectroscopy (MS). Specific HPLC methods for the specific examples are provided herein.

IV. Bio-Production Reactors and Systems

Fermentation systems utilizing methods and/or compositions according to the invention are also within the scope of the invention.

Any of the recombinant microorganisms as described and/or referred to herein may be introduced into an industrial bio-production system where the microorganisms convert a carbon source into 3-HP in a commercially viable operation. The bio-production system includes the introduction of such a recombinant microorganism into a bioreactor vessel, with a carbon source substrate and bio-production media suitable for growing the recombinant microorganism, and maintaining the bio-production system within a suitable temperature range (and dissolved oxygen concentration range if the reaction is aerobic or microaerobic) for a suitable time to obtain a desired conversion of a portion of the substrate molecules to 3-HP. Industrial bio-production systems and their operation are well-known to those skilled in the arts of chemical engineering and bioprocess engineering.

Bio-productions may be performed under aerobic, microaerobic, or anaerobic conditions, with or without agitation. The operation of cultures and populations of microorganisms to achieve aerobic, microaerobic and anaerobic conditions are known in the art, and dissolved oxygen levels of a liquid culture comprising a nutrient media and such microorganism populations may be monitored to maintain or confirm a desired aerobic, microaerobic or anaerobic condition. When syngas is used as a feedstock, aerobic, microaerobic, or anaerobic conditions may be utilized. When sugars are used, anaerobic, aerobic or microaerobic conditions can be implemented in various embodiments.

Any of the recombinant microorganisms as described and/or referred to herein may be introduced into an industrial bio-production system where the microorganisms convert a carbon source into 3-HP, and optionally in various embodiments also to one or more downstream compounds of 3-HP in a commercially viable operation. The bio-production system includes the introduction of such a recombinant microorganism into a bioreactor vessel, with a carbon source substrate and bio-production media suitable for growing the recombinant microorganism, and maintaining the bio-production system within a suitable temperature range (and dissolved oxygen concentration range if the reaction is aerobic or microaerobic) for a suitable time to obtain a desired conversion of a portion of the substrate molecules to 3-HP.

In various embodiments, syngas components or sugars are provided to a microorganism, such as in an industrial system comprising a reactor vessel in which a defined media (such as a minimal salts media including but not limited to M9 minimal media, potassium sulfate minimal media, yeast synthetic minimal media and many others or variations of these), an inoculum of a microorganism providing an embodiment of the biosynthetic pathway(s) taught herein, and the carbon source may be combined. The carbon source enters the cell and is catabolized by well-known and common metabolic pathways to yield common metabolic intermediates, including phosphoenolpyruvate (PEP). (See *Molecular Biology of the Cell*, $3^{rd}$ Ed., B. Alberts et al. Garland Publishing, New York, 1994, pp. 42-45, 66-74, incorporated by reference for the teachings of basic metabolic catabolic pathways for sugars; *Principles of Biochemistry*, $3^{rd}$ Ed., D. L. Nelson & M. M. Cox, Worth Publishers, New York, 2000, pp. 527-658, incorporated by reference for the teachings of major metabolic pathways; and *Biochemistry*, $4^{th}$ Ed., L. Stryer, W. H. Freeman and Co., New York, 1995, pp. 463-650, also incorporated by reference for the teachings of major metabolic pathways.).

Further to types of industrial bio-production, various embodiments of the present invention may employ a batch type of industrial bioreactor. A classical batch bioreactor system is considered "closed" meaning that the composition of the medium is established at the beginning of a respective bio-production event and not subject to artificial alterations and additions during the time period ending substantially with the end of the bio-production event. Thus, at the beginning of the bio-production event the medium is inoculated with the desired organism or organisms, and bio-production is permitted to occur without adding anything to the system. Typically, however, a "batch" type of bio-production event is batch with respect to the addition of carbon source and attempts are often made at controlling factors such as pH and oxygen concentration. In batch systems the metabolite and biomass compositions of the system change constantly up to the time the bio-production event is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of a desired end product or intermediate.

A variation on the standard batch system is the fed-batch system. Fed-batch bio-production processes are also suitable in the present invention and comprise a typical batch system with the exception that the nutrients, including the substrate, are added in increments as the bio-production progresses. Fed-Batch systems are useful when catabolite repression is apt to inhibit the metabolism of the cells and where it is desirable to have limited amounts of substrate in the media. Measurement of the actual nutrient concentration in Fed-Batch systems may be measured directly, such as by sample analysis at different times, or estimated on the basis of the changes of measurable factors such as pH, dissolved oxygen and the partial pressure of waste gases such as $CO_2$. Batch and fed-batch approaches are common and well known in the art and examples may be found in Thomas D. Brock in *Biotechnology: A Textbook of Industrial Microbiology*, Second Edition (1989) Sinauer Associates, Inc., Sunderland, Mass., Deshpande, Mukund V., Appl. Biochem. Biotechnol., 36:227, (1992), and *Biochemical Engineering Fundamentals*, $2^{nd}$ Ed. J. E. Bailey and D. F. Ollis, McGraw Hill, New York, 1986, herein incorporated by reference for general instruction on bio-production.

Although embodiments of the present invention may be performed in batch mode, or in fed-batch mode, it is contemplated that the invention would be adaptable to continuous bio-production methods. Continuous bio-production is considered an "open" system where a defined bio-production medium is added continuously to a bioreactor and an equal amount of conditioned media is removed simultaneously for processing. Continuous bio-production generally maintains the cultures within a controlled density range where cells are primarily in log phase growth. Two types of continuous bioreactor operation include a chemostat, wherein fresh media is fed to the vessel while simultaneously removing an equal rate of the vessel contents. The limitation of this approach is that cells are lost and high cell density generally is not achievable. In fact, typically one can obtain much higher cell density with a fed-batch process. Another continuous bioreactor utilizes perfusion culture, which is similar to the chemostat approach except that the stream that is removed from the vessel is subjected to a separation technique which recycles viable cells back to the vessel. This type of continuous bioreactor operation has been shown to yield significantly higher cell densities than fed-batch and can be operated continuously. Continuous bio-production is particularly advantageous for industrial operations because it has less down time associated with draining, cleaning and preparing the equipment for the next bio-production event. Furthermore, it is typically more economical to continuously operate downstream unit operations, such as distillation, than to run them in batch mode.

Continuous bio-production allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by media turbidity, is kept constant. Methods of modulating nutrients and growth factors for continuous bio-production processes as well as techniques for maximizing the rate of product formation are well known in the art of industrial microbiology and a variety of methods are detailed by Brock, supra.

It is contemplated that embodiments of the present invention may be practiced using either batch, fed-batch or continuous processes and that any known mode of bio-production would be suitable. It is contemplated that cells may be immobilized on an inert scaffold as whole cell catalysts and subjected to suitable bio-production conditions for 3-HP production, or be cultured in liquid media in a vessel, such as a culture vessel. Thus, embodiments used in such processes, and in bio-production systems using these processes, include a population of genetically modified microorganisms of the present invention, a culture system comprising such population in a media comprising nutrients for the population, and methods of making 3-HP and thereafter, a downstream product of 3-HP.

Embodiments of the invention include methods of making 3-HP in a bio-production system, some of which methods may include obtaining 3-HP after such bio-production event. For example, a method of making 3-HP may comprise: providing to a culture vessel a media comprising suitable nutrients; providing to the culture vessel an inoculum of a genetically modified microorganism comprising genetic modifications described herein such that the microorganism produces 3-HP from syngas and/or a sugar molecule; and maintaining the culture vessel under suitable conditions for the genetically modified microorganism to produce 3-HP.

It is within the scope of the present invention to produce, and to utilize in bio-production methods and systems, including industrial bio-production systems for production of 3-HP, a recombinant microorganism genetically engineered to modify one or more aspects effective to increase tolerance to 3-HP (and, in some embodiments, also 3-HP bio-production) by at least 20 percent over control microorganism lacking the one or more modifications.

In various embodiments, the invention is directed to a system for bioproduction of acrylic acid as described herein, said system comprising: a tank for saccharification of biomass; a line for passing the product of saccharification to a fermentation tank optionally via a pre-fermentation tank; a fermentation tank suitable for microorganism cell culture; a line for discharging contents from the fermentation tank to an extraction and/or separation vessel; an extraction and/or separation vessel suitable for removal of 3-hydroxypropionic acid from cell culture waste; a line for transferring 3-hydroxypropionic acid to a dehydration vessel; and a dehydration vessel suitable for conversion of 3-hydroxypropionic acid to acrylic acid. In various embodiments, the system includes one or more pre-fermentation tanks, distillation columns, centrifuge vessels, back extraction columns, mixing vessels, or combinations thereof.

The following published resources are incorporated by reference herein for their respective teachings to indicate the level of skill in these relevant arts, and as needed to support a disclosure that teaches how to make and use methods of industrial bio-production of 3-HP, or other product(s) produced under the invention, from sugar sources, and also industrial systems that may be used to achieve such conversion with any of the recombinant microorganisms of the present invention (Biochemical Engineering Fundamentals, $2^{nd}$ Ed. J. E. Bailey and D. F. Ollis, McGraw Hill, New York, 1986, entire book for purposes indicated and Chapter 9, pages 533-657 in particular for biological reactor design; Unit Operations of Chemical Engineering, $5^{th}$ Ed., W. L. McCabe et al., McGraw Hill, New York 1993, entire book for purposes indicated, and particularly for process and separation technologies analyses; Equilibrium Staged Separations, P. C. Wankat, Prentice Hall, Englewood Cliffs, N.J. USA, 1988, entire book for separation technologies teachings). Generally, it is further appreciated, in view of the disclosure, that any of the above methods and systems may be used for production of chemical products other than 3-HP.

V. Genetic Modifications, Nucleotide Sequences, and Amino Acid Sequences

Embodiments of the present invention may result from introduction of an expression vector into a host microorganism, wherein the expression vector contains a nucleic acid sequence coding for an enzyme that is, or is not, normally found in a host microorganism.

The ability to genetically modify a host cell is essential for the production of any genetically modified (recombinant) microorganism. The mode of gene transfer technology may be by electroporation, conjugation, transduction, or natural transformation. A broad range of host conjugative plasmids and drug resistance markers are available. The cloning vectors are tailored to the host organisms based on the nature of antibiotic resistance markers that can function in that host. Also, as disclosed herein, a genetically modified (recombinant) microorganism may comprise modifications other than via plasmid introduction, including modifications to its genomic DNA.

It has long been recognized in the art that some amino acids in amino acid sequences can be varied without significant effect on the structure or function of proteins. Variants included can constitute deletions, insertions, inversions, repeats, and type substitutions so long as the indicated enzyme activity is not significantly adversely affected. Guidance concerning which amino acid changes are likely to be phenotypically silent can be found, inter alia, in Bowie, J. U., et al., "Deciphering the Message in Protein Sequences: Tolerance to Amino Acid Substitutions," Science 247:1306-1310 (1990). This reference is incorporated by reference for such teachings, which are, however, also generally known to those skilled in the art.

In various embodiments polypeptides obtained by the expression of the polynucleotide molecules of the present invention may have at least approximately 50%, 60%, 70%, 80%, 90%, 95%, 96%, 97%, 98%, 99% or 100% identity to one or more amino acid sequences encoded by the genes and/or nucleic acid sequences described herein for the 3-HP tolerance-related and biosynthesis pathways.

As a practical matter, whether any particular polypeptide is at least 50%, 60%, 70%, 80%, 85%, 90%, 92%, 95%, 96%, 97%, 98% or 99% identical to any reference amino acid sequence of any polypeptide described herein (which may correspond with a particular nucleic acid sequence described herein), such particular polypeptide sequence can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set such that the percentage of identity is calculated over the full length of the reference amino acid sequence and that gaps in homology of up to 5% of the total number of amino acid residues in the reference sequence are allowed.

For example, in a specific embodiment the identity between a reference sequence (query sequence, i.e., a sequence of the present invention) and a subject sequence, also referred to as a global sequence alignment, may be determined using the FASTDB computer program based on the algorithm of Brutlag et al. (Comp. App. Biosci. 6:237-245 (1990)). Preferred parameters for a particular embodiment in which identity is narrowly construed, used in a FASTDB amino acid alignment, are: Scoring Scheme=PAM (Percent Accepted Mutations) 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter. According to this embodiment, if the subject sequence is shorter than the query sequence due to N- or C-terminal deletions, not because of internal deletions, a manual correction is made to the results to take into consideration the fact that the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are lateral to the N- and C-terminal of the subject sequence, which are not matched/aligned with a corresponding subject residue, as a percent of the total bases of the query sequence. A determination of whether a residue is matched/aligned is determined by results of the FASTDB sequence alignment. This percentage is then subtracted from the percent identity, calculated by the FASTDB program using the specified parameters, to arrive at a final percent identity score. This final percent identity score is what is used for the purposes of this embodiment. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence are considered for this manual correction. For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for.

More generally, nucleic acid constructs can be prepared comprising an isolated polynucleotide encoding a polypeptide having enzyme activity operably linked to one or more (several) control sequences that direct the expression of the coding sequence in a microorganism, such as E. coli, under conditions compatible with the control sequences. The isolated polynucleotide may be manipulated to provide for expression of the polypeptide. Manipulation of the polynucleotide's sequence prior to its insertion into a vector may be desirable or necessary depending on the expression vector. The techniques for modifying polynucleotide sequences utilizing recombinant DNA methods are well established in the art.

The control sequence may be an appropriate promoter sequence, a nucleotide sequence that is recognized by a host cell for expression of a polynucleotide encoding a polypeptide of the present invention. The promoter sequence contains transcriptional control sequences that mediate the expression of the polypeptide. The promoter may be any nucleotide sequence that shows transcriptional activity in the host cell of choice including mutant, truncated, and hybrid promoters, and may be obtained from genes encoding extracellular or intracellular polypeptides either homologous or heterologous to the host cell. Examples of suitable promoters for directing transcription of the nucleic acid constructs, especially in an E. coli host cell, are the lac promoter (Gronenborn, 1976, Mol. Gen. Genet. 148: 243-250), tac promoter (DeBoer et a/., 1983, Proceedings of the National Academy of Sciences USA 80: 21-25), trc promoter (Brosius et al, 1985, J. Biol. Chem. 260: 3539-3541), T7 RNA polymerase promoter (Studier and Moffatt, 1986, J. Mol. Biol. 189: 113-130), phage promoter $p_L$ (Elvin et al., 1990, Gene 87: 123-126), tetA prmoter (Skerra, 1994, Gene 151: 131-135), araBAD promoter (Guzman et al., 1995, J. Bacteriol. 177: 4121-4130), and rhaP$_{BAD}$ promoter (Haldimann et al., 1998, J. Bacteriol. 180: 1277-1286). Other promoters are described in "Useful proteins from recombinant bacteria" in Scientific American, 1980, 242: 74-94; and in Sambrook and Russell, "Molecular Cloning: A Laboratory Manual," Third Edition 2001 (volumes 1-3), Cold Spring Harbor Laboratory Press, Cold Spring Harbor, N.Y.

The control sequence may also be a suitable transcription terminator sequence, a sequence recognized by a host cell to terminate transcription. The terminator sequence is operably linked to the 3' terminus of the nucleotide sequence encoding the polypeptide. Any terminator that is functional in an E. coli cell may be used in the present invention. It may also be desirable to add regulatory sequences that allow regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems.

For various embodiments of the invention the genetic manipulations may be described to include various genetic manipulations, including those directed to change regulation of, and therefore ultimate activity of, an enzyme or enzymatic activity of an enzyme identified in any of the respective pathways. Such genetic modifications may be directed to transcriptional, translational, and post-translational modifications that result in a change of enzyme activity and/or selectivity under selected and/or identified culture conditions and/or to provision of additional nucleic acid sequences such as to increase copy number and/or mutants of an enzyme related to 3-HP production. Specific methodologies and approaches to achieve such genetic modification are well known to one skilled in the art, and include, but are not limited to: increasing expression of an endogenous genetic element; decreasing functionality of a repressor gene; introducing a heterologous genetic element; increasing copy number of a nucleic acid sequence encoding a polypeptide catalyzing an enzymatic conversion step to produce 3-HP; mutating a genetic element to provide a mutated protein to increase specific enzymatic activity; over-expressing; under-expressing; over-expressing a chaperone; knocking out a protease; altering or modifying feedback inhibition; providing an enzyme variant comprising one or more of an impaired binding site for a repressor and/or competitive inhibitor; knocking out a repressor gene; evolution, selection and/or other approaches to improve mRNA stability as well as use of plasmids having an effective copy number and promoters to achieve an effective level of improvement. Random mutagenesis may be practiced to provide genetic modifications that may fall into any of these or other stated approaches. The genetic modifications further broadly fall into additions (including insertions), deletions (such as by a mutation) and substitutions of one or more nucleic acids in a nucleic acid of interest. In various embodiments a genetic modification results in improved enzymatic specific activity and/or turn-over number of an enzyme. Without being limited, changes may be measured by one or more of the following: $K_M$; $K_{cat}$; and $K_{avidity}$.

In various embodiments, to function more efficiently, a microorganism may comprise one or more gene deletions. For example, in E. coli, the genes encoding the lactate dehydrogenase (ldhA), phosphate acetyltransferase (pta), pyruvate oxidase (poxB), and pyruvate-formate lyase (pflB) may be disrupted, including deleted. Such gene disruptions, including deletions, are not meant to be limiting, and may be implemented in various combinations in various embodiments. Gene deletions may be accomplished by mutational gene deletion approaches, and/or starting with a mutant strain having reduced or no expression of one or more of these enzymes, and/or other methods known to those skilled in the art. Gene deletions may be effectuated by any of a number of known specific methodologies, including but not limited to the RED/ET methods using kits and other reagents sold by Gene Bridges (Gene Bridges GmbH, Dresden, Germany, <<www.genebridges.com>>).

More particularly as to the latter method, use of Red/ET recombination, is known to those of ordinary skill in the art and described in U.S. Pat. Nos. 6,355,412 and 6,509,156, issued to Stewart et al. and incorporated by reference herein for its teachings of this method. Material and kits for such method are available from Gene Bridges (Gene Bridges GmbH, Dresden, Germany, <<www.genebridges.com>>), and the method may proceed by following the manufacturer's instructions. The method involves replacement of the target gene by a selectable marker via homologous recombination performed by the recombinase from λ-phage. The host organism expressing λ-red recombinase is transformed with a linear DNA product coding for a selectable marker flanked by the terminal regions (generally ~50 bp, and alternatively up to about ~300 bp) homologous with the target gene. The marker could then be removed by another recombination step performed by a plasmid vector carrying the FLP-recombinase, or another recombinase, such as Cre.

Targeted deletion of parts of microbial chromosomal DNA or the addition of foreign genetic material to microbial chromomes may be practiced to alter a host cell's metabolism so as to reduce or eliminate production of undesired metabolic products. This may be used in combination with other genetic modifications such as described herein in this general example. In this detailed description, reference has been made to multiple embodiments and to the accompanying drawings in which is shown by way of illustration specific exemplary embodiments in which the invention may be practiced. These embodiments are described in sufficient detail to enable those skilled in the art to practice the invention, and it is to be understood that modifications to the various disclosed embodiments may be made by a skilled artisan.

Further, for 3-HP production, such genetic modifications may be chosen and/or selected for to achieve a higher flux rate through certain enzymatic conversion steps within the respective 3-HP production pathway and so may affect general cellular metabolism in fundamental and/or major ways.

It will be appreciated that amino acid "homology" includes conservative substitutions, i.e. those that substitute a given amino acid in a polypeptide by another amino acid of similar characteristics. Typically seen as conservative substitutions are the following replacements: replacements of an aliphatic amino acid such as Ala, Val, Leu and Ile with another aliphatic amino acid; replacement of a Ser with a Thr or vice versa; replacement of an acidic residue such as Asp or Glu with another acidic residue; replacement of a residue bearing an amide group, such as Asn or Gln, with another residue bearing an amide group; exchange of a basic residue such as Lys or Arg with another basic residue; and replacement of an aromatic residue such as Phe or Tyr with another aromatic residue.

For all nucleic acid and amino acid sequences provided herein, it is appreciated that conservatively modified variants of these sequences are included, and are within the scope of the invention in its various embodiments. Functionally equivalent nucleic acid and amino acid sequences (functional variants), which may include conservatively modified variants as well as more extensively varied sequences, which are well within the skill of the person of ordinary skill in the art, and microorganisms comprising these, also are within the scope of various embodiments of the invention, as are methods and systems comprising such sequences and/or microorganisms. In various embodiments, nucleic acid sequences encoding sufficiently homologous proteins or portions thereof are within the scope of the invention. More generally, nucleic acids sequences that encode a particular amino acid sequence employed in the invention may vary due to the degeneracy of the genetic code, and nonetheless fall within the scope of the invention. The following table provides a summary of similarities among amino acids, upon which conservative and less conservative substitutions may be based, and also various codon redundancies that reflect this degeneracy.

TABLE 1

| Amino Acid | Relation-ships | DNA codons |
|---|---|---|
| Alanine | N, Ali | GCT, GCC, GCA, GCG |
| Proline | N | CCT, CCC, CCA, CCG |
| Valine | N, Ali | GTT, GTC, GTA, GTG |
| Leucine | N, Ali | CTT, CTC, CTA, CTG, TTA, TTG |
| Isoleucine | N, Ali | ATT, ATC, ATA |
| Methionine | N | ATG |
| Phenyl-alanine | N, Aro | TTT, TTC |
| Tryptophan | N | TGG |
| Glycine | PU | GGT, GGC, GGA, GGG |
| Serine | PU | TCT, TCC, TCA, TCG, AGT, AGC |
| Threonine | PU | ACT, ACC, ACA, ACG |
| Asparagine | PU, Ami | AAT, AAC |
| Glutamine | PU, Ami | CAA, CAG |
| Cysteine | PU | TGT, TGC |
| Aspartic acid | NEG, A | GAT, GAC |
| Glutamic acid | NEG, A | GAA, GAG |
| Arginine | POS, B | CGT, CGC, CGA, CGG, AGA, AGG |
| Lysine | POS, B | AAA, AAG |
| Histidine | POS | CAT, CAC |
| Tyrosine | Aro | TAT, TAC |
| Stop Codons | | TAA, TAG, TGA |

Legend:
side groups and other related properties: A = acidic; B = basic; Ali = aliphatic; Ami = amine; Aro = aromatic; N = nonpolar; PU = polar uncharged; NEG = negatively charged; POS = positively charged.

Also, variants and portions of particular nucleic acid sequences, and respective encoded amino acid sequences recited herein may be exhibit a desired functionality, e.g., enzymatic activity at a selected level, when such nucleic acid sequence variant and/or portion contains a 15 nucleotide sequence identical to any 15 nucleotide sequence set forth in the nucleic acid sequences recited herein including, without limitation, the sequence starting at nucleotide number 1 and ending at nucleotide number 15, the sequence starting at nucleotide number 2 and ending at nucleotide number 16, the sequence starting at nucleotide number 3 and ending at nucleotide number 17, and so forth. It will be appreciated that the invention also provides isolated nucleic acid that contains a nucleotide sequence that is greater than 15 nucleotides (e.g., 16, 17, 18, 19, 20, 21, 22, 23, 24, 25, 26, 27, 28, 29, 30 or more nucleotides) in length and identical to any portion of the sequence set forth in nucleic acid sequences recited herein. For example, the invention provides isolated nucleic acid that contains a 25 nucleotide sequence identical to any 25 nucleotide sequence set forth in any one or more (including any grouping of) nucleic acid sequences recited herein including, without limitation, the sequence starting at nucleotide number 1 and ending at nucleotide number 25, the sequence starting at nucleotide number 2 and ending at nucleotide number 26, the sequence starting at nucleotide number 3 and ending at nucleotide number 27, and so forth. Additional examples include, without limitation, isolated nucleic acids that contain a nucleotide sequence that is 50 or more nucleotides (e.g., 100, 150, 200, 250, 300, or more nucleotides) in length and identical to any portion of any of the sequences disclosed herein. Such isolated nucleic acids can include, without limitation, those isolated nucleic acids containing a nucleic acid sequence represented in any one section of discussion and/or examples, such as regarding 3-HP production pathways, nucleic acid sequences encoding enzymes of the fatty acid synthase system, or 3-HP tolerance. For example, the invention provides an isolated nucleic acid containing a nucleic acid sequence listed herein that contains a single insertion, a single deletion, a single substitution, multiple insertions, multiple deletions, multiple substitutions, or any combination thereof (e.g., single deletion together with multiple insertions). Such isolated nucleic acid molecules can share at least 60, 65, 70, 75, 80, 85, 90, 95, 97, 98, or 99 percent sequence identity with a nucleic acid sequence listed herein (i.e., in the sequence listing).

Additional examples include, without limitation, isolated nucleic acids that contain a nucleic acid sequence that encodes an amino acid sequence that is 50 or more amino acid residues (e.g., 100, 150, 200, 250, 300, or more amino acid residues) in length and identical to any portion of an amino acid sequence listed or otherwise disclosed herein.

In addition, the invention provides isolated nucleic acid that contains a nucleic acid sequence that encodes an amino acid sequence having a variation of an amino acid sequence listed or otherwise disclosed herein. For example, the invention provides isolated nucleic acid containing a nucleic acid sequence encoding an amino acid sequence listed or otherwise disclosed herein that contains a single insertion, a single deletion, a single substitution, multiple insertions, multiple deletions, multiple substitutions, or any combination thereof (e.g., single deletion together with multiple insertions). Such isolated nucleic acid molecules can contain a nucleic acid sequence encoding an amino acid sequence that shares at least 60, 65, 70, 75, 80, 85, 90, 95, 97, 98, or 99 percent sequence identity with an amino acid sequence listed or otherwise disclosed herein.

Examples of properties that provide the bases for conservative and other amino acid substitutions are exemplified in Table 1. Accordingly, one skilled in the art may make numerous substitutions to obtain an amino acid sequence variant that exhibits a desired functionality. BLASTP, CLUSTALP, and other alignment and comparison tools may be used to assess highly conserved regions, to which fewer substitutions may be made (unless directed to alter activity to a selected level, which may require multiple substitutions). More substitutions may be made in regions recognized or believed to not be involved with an active site or other binding or structural motif. In accordance with Table 1, for example, substitutions may be made of one polar uncharged (PU) amino acid for a polar uncharged amino acid of a listed sequence, optionally considering size/molecular weight (i.e., substituting a serine for a threonine). Guidance concerning which amino acid changes are likely to be phenotypically silent can be found, inter alia, in Bowie, J. U., et Al., "Deciphering the Message in Protein Sequences: Tolerance to Amino Acid Substitutions," Science 247:1306-1310 (1990). This reference is incorporated by reference for such teachings, which are, however, also generally known to those skilled in the art. Recognized conservative amino acid substitutions comprise (substitutable amino acids following each colon of a set): ala:ser; arg:lys; asn:gln or his; asp:glu; cys:ser; gln:asn; glu:asp; gly:pro; his:asn or gln; ile:leu or val; leu:ile or val; lys:arg or gln or glu; met:leu or ile; phe:met or leu or tyr; ser:thr; thr:ser; trp:tyr; tyr:trp or phe; val:ile or leu.

It is noted that codon preferences and codon usage tables for a particular species can be used to engineer isolated nucleic acid molecules that take advantage of the codon usage preferences of that particular species. For example, the isolated nucleic acid provided herein can be designed to have codons that are preferentially used by a particular organism of interest. Numerous software and sequencing services are available for such codon-optimizing of sequences.

The invention provides polypeptides that contain the entire amino acid sequence of an amino acid sequence listed or otherwise disclosed herein. In addition, the invention provides polypeptides that contain a portion of an amino acid sequence listed or otherwise disclosed herein. For example, the invention provides polypeptides that contain a 15 amino acid sequence identical to any 15 amino acid sequence of an amino acid sequence listed or otherwise disclosed herein including, without limitation, the sequence starting at amino acid residue number 1 and ending at amino acid residue number 15, the sequence starting at amino acid residue number 2 and ending at amino acid residue number 16, the sequence starting at amino acid residue number 3 and ending at amino acid residue number 17, and so forth. It will be appreciated that the invention also provides polypeptides that contain an amino acid sequence that is greater than 15 amino acid residues (e.g., 16, 17, 18, 19, 20, 21, 22, 23, 24, 25, 26, 27, 28, 29, 30 or more amino acid residues) in length and identical to any portion of an amino acid sequence listed or otherwise disclosed herein For example, the invention provides polypeptides that contain a 25 amino acid sequence identical to any 25 amino acid sequence of an amino acid sequence listed or otherwise disclosed herein including, without limitation, the sequence starting at amino acid residue number 1 and ending at amino acid residue number 25, the sequence starting at amino acid residue number 2 and ending at amino acid residue number 26, the sequence starting at amino acid residue number 3 and ending at amino acid residue number 27, and so forth. Additional examples include, without limitation, polypeptides that contain an amino acid sequence that is 50 or more amino acid residues (e.g., 100, 150, 200, 250, 300 or more amino acid residues) in length and identical to any portion of an amino acid sequence listed or otherwise disclosed herein. Further, it is appreciated that, per above, a 15 nucleotide sequence will provide a 5 amino acid sequence, so that the latter, and higher-length amino acid sequences, may be defined by the above-described nucleotide sequence lengths having identity with a sequence provided herein.

In addition, the invention provides polypeptides that an amino acid sequence having a variation of the amino acid sequence set forth in an amino acid sequence listed or otherwise disclosed herein. For example, the invention provides polypeptides containing an amino acid sequence listed or otherwise disclosed herein that contains a single insertion, a single deletion, a single substitution, multiple insertions, multiple deletions, multiple substitutions, or any combination thereof (e.g., single deletion together with multiple insertions). Such polypeptides can contain an amino acid sequence that shares at least 60, 65, 70, 75, 80, 85, 90, 95, 97, 98 or 99 percent sequence identity with an amino acid sequence listed or otherwise disclosed herein. A particular variant amino acid sequence may comprise any number of variations as well as any combination of types of variations.

The invention includes, in various embodiments, an amino acid sequence having a variation of any of the polynucleotide and polypeptide sequences disclosed herein. As one example, variations are exemplified for the carbonic anhydrase (*E. coli* cynT) amino acid sequence set forth in SEQ ID NO:544. FIG. 3 provides a CLUSTAL multiple sequence alignment of the *E. coli* carbonic anhydrase aligned with carbonic anhydrases of eleven other species that had relatively high homology, based on low E values, in a BLASTP comparison. SEQ ID NO:544 is the fifth sequence shown. Multiple conservative and less conservative substitutions are shown (i.e., by the ":" and "." designations, respectively), which can lead to additional modifications by one skilled in the art. Thus, examples of variations of the sequence set forth in SEQ ID NO:544 include, without limitation, any variation of the sequences as set forth in FIG. 3. Such variations are provided in FIG. 3 in that a comparison of the amino acid residue (or lack thereof) at a particular position of the sequence set forth in SEQ ID NO:544 with the amino acid residue (or lack thereof) at the same aligned position of any of the other eleven amino acid sequences of FIG. 3 provides a list of specific changes for the sequence set forth in SEQ ID NO:544. For example, the "E" glutamic acid at position 14 of SEQ ID NO:544 can be substituted with a "D" aspartic acid or "N" asparagine as indicated in FIG. 3. It will be appreciated that the sequence set forth in SEQ ID NO:544 can contain any number of variations as well as any combination of types of variations. It is noted that the amino acid sequences provided in FIG. 3 can be polypeptides having carbonic anhydrase activity.

As indicated herein, polypeptides having a variant amino acid sequence can retain enzymatic activity. Such polypeptides can be produced by manipulating the nucleotide sequence encoding a polypeptide using standard procedures such as site-directed mutagenesis or various PCR techniques. As noted herein, one type of modification includes the substitution of one or more amino acid residues for amino acid residues having a similar chemical and/or biochemical property. For example, a polypeptide can have an amino acid sequence set forth in an amino acid sequence listed or otherwise disclosed herein comprising one or more conservative substitutions.

More substantial changes can be obtained by selecting substitutions that are less conservative, and/or in areas of the sequence that may be more critical, for example selecting residues that differ more significantly in their effect on maintaining: (a) the structure of the polypeptide backbone in the area of the substitution, for example, as a sheet or helical conformation; (b) the charge or hydrophobicity of the polypeptide at the target site; or (c) the bulk of the side chain. The substitutions that in general are expected to produce the greatest changes in polypeptide function are those in which: (a) a hydrophilic residue, e.g., serine or threonine, is substituted for (or by) a hydrophobic residue, e.g., leucine, isoleucine, phenylalanine, valine or alanine; (b) a cysteine or proline is substituted for (or by) any other residue; (c) a residue having an electropositive side chain, e.g., lysine, arginine, or histidine, is substituted for (or by) an electronegative residue, e.g., glutamic acid or aspartic acid; or (d) a residue having a bulky side chain, e.g., phenylalanine, is substituted for (or by) one not having a side chain, e.g., glycine. The effects of these amino acid substitutions (or other deletions or additions) can be assessed for polypeptides having enzymatic activity by analyzing the ability of the polypeptide to catalyze the conversion of the same substrate as the related native polypeptide to the same product as the related native polypeptide. Accordingly, polypeptides having 5, 10, 20, 30, 40, 50 or less conservative substitutions are provided by the invention.

Polypeptides and nucleic acids encoding polypeptides can be produced by standard DNA mutagenesis techniques, for example, M13 primer mutagenesis. Details of these techniques are provided in Sambrook and Russell, 2001. Nucleic acid molecules can contain changes of a coding region to fit the codon usage bias of the particular organism into which the molecule is to be introduced.

Alternatively, the coding region can be altered by taking advantage of the degeneracy of the genetic code to alter the coding sequence in such a way that, while the nucleic acid sequence is substantially altered, it nevertheless encodes a polypeptide having an amino acid sequence identical or substantially similar to the native amino acid sequence. For example, alanine is encoded in the open reading frame by the nucleotide codon triplet GCT. Because of the degeneracy of the genetic code, three other nucleotide codon triplets— GCA, GCC, and GCG—also code for alanine. Thus, the nucleic acid sequence of the open reading frame can be changed at this position to any of these three codons without affecting the amino acid sequence of the encoded polypeptide or the characteristics of the polypeptide. Based upon the degeneracy of the genetic code, nucleic acid variants can be derived from a nucleic acid sequence disclosed herein using standard DNA mutagenesis techniques as described herein, or by synthesis of nucleic acid sequences. Thus, for various embodiments the invention encompasses nucleic acid molecules that encode the same polypeptide but vary in nucleic acid sequence by virtue of the degeneracy of the genetic code.

The invention also provides an isolated nucleic acid that is at least about 12 bases in length (e.g., at least about 13, 14, 15, 16, 17, 18, 19, 20, 25, 30, 40, 50, 60, 100, 250, 500, 750, 1000, 1500, 2000, 3000, 4000, or 5000 bases in length) and hybridizes, under hybridization conditions, to the sense or antisense strand of a nucleic acid having a sequence listed or otherwise disclosed herein. The hybridization conditions can be moderately or highly stringent hybridization conditions. Also, in some embodiments the microorganism comprises an endogenous 3-HP production pathway (which may, in some such embodiments, be enhanced), whereas in other embodiments the microorganism does not comprise a 3-HP production pathway, but is provided with one or more nucleic acid sequences encoding polypeptides having enzymatic activity or activities to complete a pathway, described herein, resulting in production of 3-HP. In some embodiments, the particular sequences disclosed herein, or conservatively modified variants thereof, are provided to a selected microorganism, such as selected from one or more of the species and groups of species or other taxonomic groups listed herein.

VI. Redirecting Malonyl-CoA from Fatty Acid Synthesis to 3-HP

Compositions of the present invention, such as genetically modified microorganisms, comprise a production pathway for a chemical product in which malonyl-CoA is a substrate, and may also comprise one or more genetic modifications to reduce the activity of enzymes encoded by one or more of the fatty acid synthetase system genes. The compositions may be used in the methods and systems of the present invention.

Regarding microbial fermentation of a number of chemical products in many microorganisms of commercial fermentation interest, malonyl-CoA is a metabolic intermediate that, under normal growth conditions, is converted to fatty acids and derivatives thereof, such as phospholipids, that are then used in cell membranes and for other key cellular functions. For example, in *Escherichia coli*, the fatty acid synthase system is a type II or dissociated fatty acid synthase system. In this system the enzymes of fatty acid production pathway are encoded by distinct genes, and, common for many critical metabolic pathways, is well-regulated, including by downstream products inhibiting upstream enzymes.

In various microorganisms conversion of the metabolic intermediate malonyl-CoA to fatty acids via a fatty acid synthesis system (i.e., pathway or complex) is the only or the major use of malonyl-CoA. It has been determined that when a production pathway to an alternative chemical product exists in a microorganism, reducing such conversion of malonyl-CoA to fatty acids can improve metrics for production of that alternative chemical product (e.g., 3-HP). For example, in many microorganism cells the fatty acid synthase system comprises polypeptides that have the following enzymatic activities: malonyl-CoA-acyl carrier protein (ACP) transacylase; β-ketoacyl-ACP synthase; β-ketoacyl-ACP reductase; β-hydroxyacyl-ACP dehydratase; 3-hydroxyacyl-(acp) dehydratase; and enoyl-acyl carrier protein reductase (enoyl-ACP reductase). In various embodiments nucleic acid sequences that encode temperature-sensitive forms of these polypeptides may be introduced in place of the native enzymes, and when such genetically modified microorganisms are cultured at elevated temperatures (at which these thermolabile polypeptides become inactivated, partially or completely, due to alterations in protein structure or complete denaturation), there is observed an increase in a product such as 3-HP. In other embodiments other types of genetic modifications may be made to otherwise modulate, such as lower, enzymatic activities of one or more of these polypeptides. In various embodiments a result of such genetic modifications is to shift malonyl-CoA utilization so that there is a reduced conversion of malonyl-CoA to fatty acids, overall biomass, and proportionally greater conversion of carbon source to a chemical product such as 3-HP. In various embodiments, the specific productivity for the microbially produced chemical product is unexpectedly high. Also, additional genetic modifications, such as to increase malonyl-CoA production, may be made for certain embodiments.

One enzyme, enoyl(acyl carrier protein) reductase (EC No. 1.3.1.9, also referred to as enoyl-ACP reductase) is a key enzyme for fatty acid biosynthesis from malonyl-CoA. In *Escherichia coli* this enzyme, FabI, is encoded by the gene fabI (See "Enoyl-Acyl Carrier Protein (fabI) Plays a Determinant Role in Completing Cycles of Fatty Acid Elongation in *Escherichia coli*," Richard J. Heath and Charles O. Rock, J. Biol. Chem. 270:44, pp. 26538-26543 (1995), incorporated by reference for its discussion of fabI and the fatty acid synthase system).

The present invention may utilize a microorganism that is provided with a nucleic acid sequence (polynucleotide) that encodes a polypeptide having enoyl-ACP reductase enzymatic activity that may be modulated during a fermentation event. For example, a nucleic acid sequence encoding a temperature-sensitive enoyl-ACP reductase may be provided in place of the native enoyl-ACP reductase, so that an elevated culture temperature results in reduced enzymatic activity, which then results in a shifting utilization of malonyl-CoA to production of a desired chemical product. At such elevated temperature the enzyme is considered non-permissive, as is the temperature. One such sequence is a mutant temperature-sensitive fabI (fabI$^{TS}$) of *E. coli*, SEQ ID NO:769 for DNA, SEQ ID NO:770 for protein.

It is appreciated that nucleic acid and amino acid sequences for enoyl-ACP reductase in species other than *E. coli* are readily obtained by conducting homology searches in known genomics databases, such as BLASTN and BLASTP. Approaches to obtaining homologues in other species and functional equivalent sequences are described herein. Accordingly, it is appreciated that the present invention may be practiced by one skilled in the art for many microorganism species of commercial interest.

Other approaches than a temperature-sensitive enoyl-ACP reductase may be employed as known to those skilled in the art, such as, but not limited to, replacing a native enoyl-ACP or enoyl-coA reductase with a nucleic acid sequence that includes an inducible promoter for this enzyme, so that an initial induction may be followed by no induction, thereby decreasing enoyl-ACP or enoyl-coA reductase enzymatic activity after a selected cell density is attained.

In some aspects, compositions, methods and systems of the present invention shift utilization of malonyl-CoA in a genetic modified microorganism, which comprises at least one enzyme of the fatty acid synthase system, such as enoyl-acyl carrier protein reductase (enoyl-ACP reductase) or enoyl-coenzyme A reductase (enoyl-coA reductase), β-ketoacyl-ACP synthase or β-ketoacyl-coA synthase malonyl-CoA-ACP, and may further comprise at least one genetic modification of nucleic acid sequence encoding carbonic anhydrase to increase bicarbonate levels in the microorganism cell and/or a supplementation of its culture medium with bicarbonate and/or carbonate, and may further comprise one or more genetic modifications to increase enzymatic activity of one or more of acetyl-CoA carboxylase and NADPH-dependent transhydrogenase. More generally, addition of carbonate and/or bicarbonate may be used to increase bicarbonate levels in a fermentation broth.

In some aspects, the present invention comprises a genetically modified microorganism that comprises at least one genetic modification that provides, completes, or enhances a 3-HP production pathway effective to convert malonyl-CoA to 3-HP, and further comprises a genetic modification of carbonic anhydrase to increase bicarbonate levels in the microorganism cell and/or a supplementation of its culture medium with bicarbonate and/or carbonate, and may further comprise one or more genetic modifications to increase enzymatic activity of one or more of acetyl-CoA carboxylase and NADPH-dependent transhydrogenase. Related methods and systems utilize such genetically modified microorganism.

In some aspects, the present invention comprises a genetically modified microorganism that comprises at least one genetic modification that provides, completes, or enhances a 3-HP production pathway effective to convert malonyl-CoA to 3-HP, and further comprises a genetic modification of at least one enzyme of the fatty acid synthase system, such as enoyl-acyl carrier protein reductase (enoyl-ACP reductase) or enoyl-coenzyme A reductase (enoyl-coA reductase), β-ketoacyl-ACP synthase or β-ketoacyl-coA synthase, malonyl-CoA-ACP, and may further comprise a genetic modification of carbonic anhydrase to increase bicarbonate levels in the microorganism cell and/or a supplementation of its culture medium with bicarbonate and/or carbonate, and may further comprise one or more genetic modifications to increase enzymatic activity of one or more of acetyl-CoA carboxylase and NADPH-dependent transhydrogenase. Related methods and systems utilize such genetically modified microorganism.

In various embodiments the present invention is directed to a method of making a chemical product comprising: providing a selected cell density of a genetically modified microorganism population in a vessel, wherein the genetically modified microorganism comprises a production pathway for production of a chemical product from malonyl-CoA; and reducing enzymatic activity of at least one enzyme of the genetically modified microorganism's fatty acid synthase pathway.

In various embodiments, reducing the enzymatic activity of an enoyl-ACP reductase in a microorganism host cell results in production of 3-HP at elevated specific and volumetric productivity. In still other embodiments, reducing the enzymatic activity of an enoyl-CoA reductase in a microorganism host cell results in production of 3-HP at elevated specific and volumetric productivity.

Another approach to genetic modification to reduce enzymatic activity of these enzymes is to provide an inducible promoter that promotes one such enzyme, such as the enoyl-ACP reductase gene (e.g., fabI in $E.\ coli$). In such example this promoter may be induced (such as with isopropyl-μ-D-thiogalactopyranoiside (IPTG)) during a first phase of a method herein, and after the IPTG is exhausted, removed or diluted out the second step, of reducing enoyl-ACP reductase enzymatic activity, may begin. Other approaches may be applied to control enzyme expression and activity such as are described herein and/or known to those skilled in the art.

While enoyl-CoA reductase is considered an important enzyme of the fatty acid synthase system, genetic modifications may be made to any combination of the polynucleotides (nucleic acid sequences) encoding the polypeptides exhibiting the enzymatic activities of this system, such as are listed herein. For example, FabB, β-ketoacyl-acyl carrier protein synthase I, is an enzyme in $E.\ coli$ that is essential for growth and the biosynthesis of both saturated and unsaturated fatty acids. Inactivation of FabB results in the inhibition of fatty acid elongation and diminished cell growth as well as eliminating a futile cycle that recycles the malonate moiety of malonyl-ACP back to acetyl-CoA. FabF, β-ketoacyl-acyl carrier protein synthase II, is required for the synthesis of saturated fatty acids and the control membrane fluidity in cells. Both enzymes are inhibited by cerulenin.

It is reported that overexpression of FabF results in diminished fatty acid biosynthesis. It is proposed that FabF outcompetes FabB for association with FabD, malonyl-CoA: ACP transacylase. The association of FabB with FabD is required for the condensation reaction that initiates fatty acid elongation. (See Microbiological Reviews, September 1993, p. 522-542 Vol. 57, No. 3; K. Magnuson et al., "Regulation of Fatty Acid Biosynthesis in *Escherichia coli*," American Society for Microbiology; W. Zha et al., "Improving cellular malonyl-CoA level in *Escherichia coli* via metabolic engineering," Metabolic Engineering 11 (2009) 192-198). An alternative to genetic modification to reduce such fatty acid synthase enzymes is to provide into a culture system a suitable inhibitor of one or more such enzymes. This approach may be practiced independently or in combination with the genetic modification approach Inhibitors, such as cerulenin, thiolactomycin, and triclosan (this list not limiting) or genetic modifications directed to reduce activity of enzymes encoded by one or more of the fatty acid synthetase system genes may be employed, singly or in combination.

Without being bound to a particular theory, it is believed that reducing the enzymatic activity of enoyl-ACP reductase (and/or of other enzymes of the fatty acid synthase system) in a microorganism leads to an accumulation and/or shunting of malonyl-CoA, a metabolic intermediate upstream of the enzyme, and such malonyl-CoA may then be converted to a chemical product for which the microorganism cell comprises a metabolic pathway that utilizes malonyl-CoA. In certain compositions, methods and systems of the present invention the reduction of enzymatic activity of enoyl-ACP reductase (or, more generally, of the fatty acid synthase system) is made to occur after a sufficient cell density of a genetically modified microorganism is attained. This bi-phasic culture approach balances a desired quantity of catalyst, in the cell biomass which supports a particular production rate, with yield, which may be partly attributed to having less carbon be directed to cell mass after the enoyl-ACP reductase activity (and/or activity of other enzymes of the fatty acid synthase system) is/are reduced. This results in a shifting net utilization of malonyl-CoA, thus providing for greater carbon flux to a desired chemical product.

In various embodiments of the present invention the specific productivity is elevated and this results in overall rapid and efficient microbial fermentation methods and systems. In various embodiments the volumetric productivity also is substantially elevated.

In various embodiments a genetically modified microorganism comprises a metabolic pathway that includes conversion of malonyl-CoA to a desired chemical product, 3-hydroxypropionic acid (3-HP). This is viewed as quite advantageous for commercial 3-HP production economics and is viewed as an advance having clear economic benefit. Other chemical products also are disclosed herein.

The improvements in both specific and volumetric productivity parameters are unexpected and advance the art.

The reduction of enoyl-ACP reductase activity and/or of other enzymes of the fatty acid synthase system may be achieved in a number of ways, as is discussed herein.

By "means for modulating" the conversion of malonyl-CoA to fatty acyl-ACP or fatty acyl-coA molecules, and to fatty acid molecules, is meant any one of the following: 1) providing in a microorganism cell at least one polynucleotide that encodes at least one polypeptide having activity of one of the fatty acid synthase system enzymes (such as recited herein), wherein the polypeptide so encoded has (such as by mutation and/or promoter substitution, etc., to lower enzymatic activity), or may be modulated to have (such as by temperature sensitivity, inducible promoter, etc.) a reduced enzymatic activity; 2) providing to a vessel comprising a microorganism cell or population an inhibitor that inhibits enzymatic activity of one or more of the fatty acid synthase system enzymes (such as recited herein), at a dosage effective to reduce enzymatic activity of one or more of these enzymes. These means may be provided in combination with one another. When a means for modulating involves a conversion, during a fermentation event, from a higher to a lower activity of the fatty acid synthetase system, such as by increasing temperature of a culture vessel comprising a population of genetically modified microorganism comprising a temperature-sensitive fatty acid synthetase system polypeptide (e.g., enoyl-ACP reductase), or by adding an inhibitor, there are conceived two modes—one during which there is higher activity, and a second during which there is lower activity, of such fatty acid synthetase system. During the lower activity mode, a shift to greater utilization of malonyl-CoA to a selected chemical product may proceed.

Once the modulation is in effect to decrease the noted enzymatic activity(ies), each respective enzymatic activity so modulated may be reduced by at least 10, at least 20, at least 30, at least 40, at least 50, at least 60, at least 70, at least 80, or at least 90 percent compared with the activity of the native, non-modulated enzymatic activity (such as in a cell or isolated). Similarly, the conversion of malonyl-CoA to fatty acyl-ACP or fatty acyl-coA molecules may be reduced by at least 10, at least 20, at least 30, at least 40, at least 50, at least 60, at least 70, at least 80, or at least 90 percent compared with such conversion in a non-modulated cell or other system. Likewise, the conversion of malonyl-CoA to fatty acid molecules may be reduced by at least 10, at least 20, at least 30, at least 40, at least 50, at least 60, at least 70, at least 80, or at least 90 percent compared with such conversion in a non-modulated cell or other system.

VII. Production Pathway from Malonyl-CoA to 3-HP

In various embodiments the compositions, methods and systems of the present invention involve inclusion of a metabolic production pathway that converts malonyl-CoA to a chemical product of interest.

As one example, 3-HP is selected as the chemical product of interest.

Further as to specific sequences for 3-HP production pathway, malonyl-CoA reductase (mcr) from *C. aurantiacus* was gene synthesized and codon optimized by the services of DNA 2.0. The FASTA sequence is shown in SEQ ID NO:783 (gi|42561982|gb|AAS20429.1|malonyl-CoA reductase (*Chloroflexus aurantiacus*)).

Mcr has very few sequence homologs in the NCBI data base. Blast searches finds 8 different sequences when searching over the entire protein. Hence development of a pile-up sequences comparison is expected to yield limited information. However, embodiments of the present invention nonetheless may comprise any of these eight sequences, shown herein and identified as SEQ ID NOs:784 to 791, which are expected to be but are not yet confirmed to be bi-functional as to this enzymatic activity. Other embodiments may comprise mutated and other variant forms of any of SEQ ID NOs:784 to 791, as well as polynucleotides (including variant forms with conservative and other substitutions), such as those introduced into a selected microorganism to provide or increase 3-HP production therein.

The portion of a CLUSTAL 2.0.11 multiple sequence alignment identifies these eight sequences with respective SEQ ID NOs: 783-791, as shown in the following table.

A mono-functional malonyl-CoA reductase in combination with a 3-HP dehydrogenase. By mono-functional is meant that the malonyl-CoA reductase catalyzes the conversion of malonyl-CoA to malonate semialdehyde.

Any of the above polypeptides may be NADH- or NADPH-dependent, and methods known in the art may be used to convert a particular enzyme to be either form. More particularly, as noted in WO 2002/042418, "any method can be used to convert a polypeptide that uses NADPH as a cofactor into a polypeptide that uses NADH as a cofactor such as those described by others (Eppink et al., J. Mol. Biol., 292 (1): 87-96 (1999), Hall and Tomsett, Microbiology, 146 (Pt 6): 1399-406 (2000), and Dohr et al., Proc. Natl. Acad. Sci., 98 (1): 81-86 (2001))."

Without being limiting, a bi-functional malonyl-CoA reductase may be selected from the malonyl-CoA reductase of *Chloroflexus aurantiacus* (such as from ATCC 29365) and other sequences. Also without being limiting, a mono-functional malonyl-CoA reductase may be selected from the malonyl-CoA reductase of *Sulfolobus tokodaii* (SEQ ID NO:826). As to the malonyl-CoA reductase of *C. aurantiacus*, that sequence and other species' sequences may also be bi-functional as to this enzymatic activity.

When a mono-functional malonyl-CoA reductase is provided in a microorganism cell, 3-HP dehydrogenase enzymatic activity also may be provided to convert malonate semialdehyde to 3-HP. As shown in the examples, a mono-functional malonyl-CoA reductase may be obtained by truncation of a bi-functional mono-functional malonyl-CoA, and combined in a strain with an enzyme that converts malonate semialdehyde to 3-HP.

Also, it is noted that another malonyl-CoA reductase is known in *Metallosphaera sedula* (Msed_709, identified as malonyl-CoA reductase/succinyl-CoA reductase).

By providing nucleic acid sequences that encode polypeptides having the above enzymatic activities, a genetically modified microorganism may comprise an effective 3-HP pathway to convert malonyl-CoA to 3-HP in accordance with the embodiments of the present invention.

Other 3-HP pathways, such as those comprising an aminotransferase (see, e.g., WO 2010/011874, published Jan. 28, 2010), may also be provided in embodiments of a genetically modified microorganism of the present invention.

TABLE 2

| Reference Nos. | Seq ID No. | Genus Species |
|---|---|---|
| gi|42561982|gb|AAS20429.1 | 783 | *Chloroflexus aurantiacus* |
| gi|163848165|ref|YP_001636209 | 784 | *Chloroflexus aurantiacus* J-10-fl |
| gi|219848167|ref|YP_002462600 | 785 | *Chloroflexus aggregans* DSM 9485 |
| gi|156742880|ref|YP_001433009 | 786 | *Roseiflexus castenholzii* DSM 13941 |
| gi|148657307|ref|YP_001277512 | 787 | *Roseiflexus* sp. RS-1 |
| gi|85708113|ref|ZP_01039179.1 | 788 | *Erythrobacter* sp. NAP1 |
| gi|254282228|ref|ZP_04957196.1 | 789 | *gamma proteobacterium* NOR51-B |
| gi|254513883|ref|ZP_05125944.1 | 790 | *gamma proteobacterium* NOR5-3 |
| gi|119504313|ref|ZP_01626393.1 | 791 | *3marine gamma proteobacterium* HTCC208 |

Malonyl-CoA may be converted to 3-HP in a microorganism that comprises one or more of the following:

A bi-functional malonyl-CoA reductase, such as may be obtained from *Chloroflexus aurantiacus* and other microorganism species. By bi-functional in this regard is meant that the malonyl-CoA reductase catalyzes both the conversion of malonyl-CoA to malonate semialdehyde, and of malonate semialdehyde to 3-HP.

Incorporated into this section, the present invention provides for elevated specific and volumetric productivity metrics as to production of a selected chemical product, such as 3-hydroxypropionic acid (3-HP). In various embodiments, production of a chemical product, such as 3-HP, is not linked to growth.

In various embodiments, production of 3-HP, or alternatively one of its downstream products such as described herein, may reach at least 1, at least 2, at least 5, at least 10, at least 20, at least 30, at least 40, and at least 50 g/liter titer, such as by using one of the methods disclosed herein.

As may be realized by appreciation of the advances disclosed herein as they relate to commercial fermentations of selected chemical products, embodiments of the present invention may be combined with other genetic modifications and/or method or system modulations so as to obtain a microorganism (and corresponding method) effective to produce at least 10, at least 20, at least 30, at least 40, at least 45, at least 50, at least 80, at least 100, or at least 120 grams of a chemical product, such as 3-HP, per liter of final (e.g., spent) fermentation broth while achieving this with specific and/or volumetric productivity rates as disclosed herein.

In some embodiments a microbial chemical production event (i.e., a fermentation event using a cultured population of a microorganism) proceeds using a genetically modified microorganism as described herein, wherein the specific productivity is between 0.01 and 0.60 grams of 3-HP produced per gram of microorganism cell on a dry weight basis per hour (g 3-HP/g DCW-hr). In various embodiments the specific productivity is greater than 0.01, greater than 0.05, greater than 0.10, greater than 0.15, greater than 0.20, greater than 0.25, greater than 0.30, greater than 0.35, greater than 0.40, greater than 0.45, or greater than 0.50 g 3-HP/g DCW-hr. Specific productivity may be assessed over a 2, 4, 6, 8, 12 or 24 hour period in a particular microbial chemical production event. More particularly, the specific productivity for 3-HP or other chemical product is between 0.05 and 0.10, 0.10 and 0.15, 0.15 and 0.20, 0.20 and 0.25, 0.25 and 0.30, 0.30 and 0.35, 0.35 and 0.40, 0.40 and 0.45, or 0.45 and 0.50 g 3-HP/g DCW-hr., 0.50 and 0.55, or 0.55 and 0.60 g 3-HP/g DCW-hr. Various embodiments comprise culture systems demonstrating such productivity.

Also, in various embodiments of the present invention the volumetric productivity achieved may be 0.25 g 3-HP (or other chemical product) per liter per hour (g (chemical product)/L-hr), may be greater than 0.25 g 3-HP (or other chemical product)/L-hr, may be greater than 0.50 g 3-HP (or other chemical product)/L-hr, may be greater than 1.0 g 3-HP (or other chemical product)/L-hr, may be greater than 1.50 g 3-HP (or other chemical product)/L-hr, may be greater than 2.0 g 3-HP (or other chemical product)/L-hr, may be greater than 2.50 g 3-HP (or other chemical product)/L-hr, may be greater than 3.0 g 3-HP (or other chemical product)/L-hr, may be greater than 3.50 g 3-HP (or other chemical product)/L-hr, may be greater than 4.0 g 3-HP (or other chemical product)/L-hr, may be greater than 4.50 g 3-HP (or other chemical product)/L-hr, may be greater than 5.0 g 3-HP (or other chemical product)/L-hr, may be greater than 5.50 g 3-HP (or other chemical product)/L-hr, may be greater than 6.0 g 3-HP (or other chemical product)/L-hr, may be greater than 6.50 g 3-HP (or other chemical product)/L-hr, may be greater than 7.0 g 3-HP (or other chemical product)/L-hr, may be greater than 7.50 g 3-HP (or other chemical product)/L-hr, may be greater than 8.0 g 3-HP (or other chemical product)/L-hr, may be greater than 8.50 g 3-HP (or other chemical product)/L-hr, may be greater than 9.0 g 3-HP (or other chemical product)/L-hr, may be greater than 9.50 g 3-HP (or other chemical product)/L-hr, or may be greater than 10.0 g 3-HP (or other chemical product)/L-hr.

In some embodiments, specific productivity as measured over a 24-hour fermentation (culture) period may be greater than 0.01, 0.05, 0.10, 0.20, 0.5, 1.0, 2.0, 3.0, 4.0, 5.0, 6.0, 7.0, 8.0, 9.0, 10.0, 11.0 or 12.0 grams of chemical product per gram DCW of microorganisms (based on the final DCW at the end of the 24-hour period).

In various aspects and embodiments of the present invention, there is a resulting substantial increase in microorganism specific productivity that advances the fermentation art and commercial economic feasibility of microbial chemical production, such as of 3-HP (but not limited thereto).

Stated in another manner, in various embodiments the specific productivity exceeds (is at least) 0.01 g chemical product/g DCW-hr, exceeds (is at least) 0.05 g chemical product/g DCW-hr, exceeds (is at least) 0.10 g chemical product/g DCW-hr, exceeds (is at least) 0.15 g chemical product/g DCW-hr, exceeds (is at least) 0.20 g chemical product/g DCW-hr, exceeds (is at least) 0.25 g chemical product/g DCW-hr, exceeds (is at least) 0.30 g chemical product/g DCW-hr, exceeds (is at least) 0.35 g chemical product/g DCW-hr, exceeds (is at least) 0.40 g chemical product/g DCW-hr, exceeds (is at least) 0.45 g chemical product/g DCW-hr, exceeds (is at least) 0.50 g chemical product/g DCW-hr, exceeds (is at least) 0.60 g chemical product/g DCW-hr.

More generally, based on various combinations of the genetic modifications described herein, optionally in combination with supplementations described herein, specific productivity values for 3-HP, and for other chemical products described herein, may exceed 0.01 g chemical product/g DCW-hr, may exceed 0.05 g chemical product/g DCW-hr, may exceed 0.10 g chemical product/g DCW-hr, may exceed 0.15 g chemical product/g DCW-hr, may exceed 0.20 g chemical product/g DCW-hr, may exceed 0.25 g chemical product/g DCW-hr, may exceed 0.30 g chemical product/g DCW-hr, may exceed 0.35 g chemical product/g DCW-hr, may exceed 0.40 g chemical product/g DCW-hr, may exceed 0.45 g chemical product/g DCW-hr, and may exceed 0.50 g or 0.60 chemical product/g DCW-hr. Such specific productivity may be assessed over a 2, 4, 6, 8, 12 or 24 hour period in a particular microbial chemical production event.

The improvements achieved by embodiments of the present invention may be determined by percentage increase in specific productivity, or by percentage increase in volumetric productivity, compared with an appropriate control microorganism lacking the particular genetic modification combinations taught herein (with or without the supplements taught herein, added to a vessel comprising the microorganism population). For particular embodiments and groups thereof, such specific productivity and/or volumetric productivity improvements is/are at least 10, at least 20, at least 30, at least 40, at least 50, at least 100, at least 200, at least 300, at least 400, and at least 500 percent over the respective specific productivity and/or volumetric productivity of such appropriate control microorganism.

The specific methods and teachings of the specification, and/or cited references that are incorporated by reference, may be incorporated into the examples. Also, production of 3-HP, or one of its downstream products such as described herein, may reach at least 1, at least 2, at least 5, at least 10, at least 20, at least 30, at least 40, and at least 50 g/liter titer in various embodiments.

The metrics may be applicable to any of the compositions, e.g., genetically modified microorganisms, methods, e.g., of producing 3-HP or other chemical products, and systems, e.g., fermentation systems utilizing the genetically modified microorganisms and/or methods disclosed herein.

It is appreciated that iterative improvements using the strategies and methods provided herein, and based on the discoveries of the interrelationships of the pathways and pathway portions, may lead to even greater 3-HP production and tolerance and more elevated 3-HP titers at the conclusion of a 3-HP bio-production event.

Any number of strategies may lead to development of a suitable modified enzyme suitable for use in a 3-HP production pathway. With regard to malonyl-CoA-reductase, one may utilize or modify an enzyme such as encoded by the sequences in the table immediately above, to achieve a suitable level of 3-HP production capability in a microorganism strain.

VIII. Increasing Tolerance to 3-HP

A complex comprising all or portions of a number of interrelated metabolic pathways has been identified, wherein genetic modification to increase enzymatic activities of enzymes of such complex, named the 3-HP Toleragenic Complex ("3HPTGC"), are demonstrated to increase microorganism tolerance to exposure to 3-HP. The 3HPTGC is described in WO 2010/011874, published Jan. 28, 2010, which is incorporated in the present application for its teachings of the 3HPTGC and combinations of genetic modifications related to 3HP production and tolerance based on the 3HPTGC and groups therein.

As described and detailed herein, the present invention broadly relates to alterations, using genetic modifications, and/or medium modulations (e.g., additions of enzymatic conversion products or other specific chemicals), to achieve desired results in microbe-based industrial bio-production methods, systems and compositions. As to the tolerance aspects, this invention flows from the discovery of the unexpected importance of the 3HPTPC which comprises certain metabolic pathway portions comprising enzymes whose increased activity (based on increasing copy numbers of nucleic acid sequences that encode there) correlates with increased tolerance of a microorganism to 3-HP.

Actual data and/or prophetic examples directed to alterations of the 3HPTGC are provided herein. These examples are intended to demonstrate the breadth of applicability (based on the large number of genomic elements related to the 3HPTGC that demonstrate increased 3-HP tolerance) and some specific approaches to achieve increased tolerance to 3-HP. Approaches may be combined to achieve additive or synergistic improvements in 3-HP tolerance, and may include alterations that are genetic or non-genetic (e.g., relating to system supplementation with particular chemicals, or general alterations to the industrial system). In addition, specific production strategies are disclosed and exemplified.

Thus, in addition to the above-described genetic modifications, directed to providing a 3-HP production pathway and to providing a nucleic acid sequence comprising and/or controlling a gene encoding an enoyl-ACP reductase that allows for control of enzymatic activity of the latter enzyme, and/or as described herein other modifications of the fatty acid synthetase system, in various embodiments one or more genetic modifications may be made to the genetically modified microorganism to increase its tolerance to 3-HP (or other chemical products).

Accordingly, in some embodiments of the present invention, a genetically modified microorganism may comprise at least one genetic modification to provide, complete, or enhance one or more 3-HP production pathways, at least one genetic modification to provide enoyl-ACP reductase enzymatic activity and/or other modifications of the fatty acid synthetase system that can be controlled so as to reduce such activity at a desired cell density, and at least one genetic modification of the 3HPTGC, or one, two, or three or more groups thereof, to increase tolerance of the genetically modified microorganism to 3-HP.

Accordingly, one aspect of the invention relates to a genetically modified microorganism comprising at least one genetic modification effective to increase 3-hydroxypropionic acid ("3-HP") production, wherein the increased level of 3-HP production is greater than the level of 3-HP production in the wild-type microorganism, and at least one genetic modification of a metabolic complex identified herein as the 3-HP Toleragenic Complex ("3HPTGC"). Under certain conditions, such as culture in minimal media, the 3HPTGC genetic modification(s) allow the genetically modified microorganism to produce 3-HP under specific culture conditions such that 3-HP may accumulate to a relatively higher concentration without the toxic effects observed in unmodified microorganisms. The at least one genetic modification of a 3-HP production pathway may be to improve 3-HP accumulation and/or production of a 3-HP production pathway found in the wild-type microorganism, or may be to provide sufficient enzymatic conversions in a microorganism that normally does not synthesize 3-HP so that 3-HP is thus bio-produced. Methods of making such genetically modified microorganisms also are described and are part of this aspect of the invention.

Another aspect of the invention relates to a genetically modified microorganism comprising at least one genetic modification from two or more of the chorismate, threonine/homocysteine, polyamine synthesis, lysine synthesis, and nucleotide synthesis portions of the 3HPTGC. Non-limiting examples of multiple combinations exemplify the advantages of this aspect of the invention. Additional genetic modifications pertain to other portions of the 3HPTGC. Capability to bio-produce 3-HP may be added to some genetically modified microorganisms by appropriate genetic modification. Methods of identifying genetic modifications to provide a microorganism achieving an increased 3-HP tolerance, and microorganisms made by such methods, relate to this aspect of the invention.

Another aspect of the invention relates to a genetically modified microorganism that is able to produce 3-hydroxypropionic acid ("3-HP"), comprising at least one genetic modification to the 3HPTGC that increases enzymatic conversion at one or more enzymatic conversion steps of the 3HPTGC for the microorganism, and wherein the at least one genetic modification increases 3-HP tolerance of the genetically modified microorganism above the 3-HP tolerance of a control microorganism lacking the genetic modification. Methods of making such genetically modified microorganisms also are described and are part of this aspect of the invention.

Another aspect of the invention relates to a genetically modified microorganism comprising various core sets of specific genetic modification(s) of the 3HPTGC. In various embodiments this aspect may additionally comprise at least one genetic modification from one or more or two or more of the chorismate, threonine/homocysteine, polyamine synthesis, lysine synthesis, and nucleotide synthesis portions of the 3HPTGC. Methods of making such genetically modified microorganisms also are described and are part of this aspect of the invention.

Further, the invention includes methods of use to improve a microorganism's tolerance to 3-HP, which may be in a microorganism having 3-HP production capability (whether the latter is naturally occurring, enhanced and/or introduced by genetic modification).

Also, another aspect of the invention is directed to providing one or more supplements, which are substrates (i.e., reactants) and/or products of the 3HPTGC (collectively herein "products" noting that substrates of all but the initial conversion steps are also products of the 3HPTGC), to a culture of a microorganism to increase the effective tolerance of that microorganism to 3-HP.

Another aspect of the invention regards the genetic modification to introduce a genetic element that encodes a short polypeptide identified herein as IroK. The introduction of genetic elements encoding this short polypeptide has been demonstrated to improve 3-HP tolerance in *E. coli* under microaerobic conditions. This genetic modification may be combined with other genetic modifications and/or supplement additions of the invention.

As to methods of making 3-HP in accordance with the teachings of this invention, and to genetically modified microorganisms that make 3-HP, one or more genetic modifications may be provided to a microorganism to increase tolerance to 3-HP. That is, SEQ ID NOs:001 to 189 are incorporated into this section, SEQ ID NOs:190 to 603 are provided as nucleic acid sequences (gene, DNA) and encoded amino acid sequences (proteins) of the *E. coli* 3HPTGC, and SEQ ID NOs:604 to 766 are provided as sequences of the nucleic acid sequences of the *Saccharomyces cerevisiae* 3HPTGC.

Moreover, a particular genetic modification to increase expression of carbonic anhydrase (for example, *E. coli*'s cynT SEQ ID NO:337 for DNA and SEQ ID NO:544 for protein sequences), may act in a dual function manner to advantageously improve both 3-HP production and 3-HP tolerance. This is particularly the case when malonyl-CoA reductase is provided for 3-HP production. FIG. 1 depicts a production pathway from malonyl-CoA to 3-HP comprising a bi-functional malonyl-CoA reductase, and other enzymatic conversions and pathways described herein. Carbonic anhydrase is not meant to be limiting. For instance, in *E. coli* a carbonic anhydrase 2 is known, variously designated as can and yadF, and use of genetic modifications in embodiments of the present invention may use this or other genes and their encoded enzymes. The sequences for can are provided as SEQ ID NO: 767 (EG12319 can "carbonic anhydrase 2 monomer" (complement (142670.142008)) *Escherichia coli* K-12 substr. MG1655) and SEQ ID NO: 768 (EG12319-MONOMER carbonic anhydrase 2 monomer (complement (142670.142008)) *Escherichia coli* K-12 substr. MG1655).

Also, it is appreciated that genetic modifications to increase 3-HP tolerance may be further classified by genetic modifications made along particular respective portions of the 3HPTGC. For example, genetic modifications may be made to polynucleotides that encode polypeptides that catalyze enzymatic reactions along specific portions of the of the 3HPTGC and so are expected to increase production of, respectively, aromatic amino acids (tyr and phe), tryptophan (trp), ubiquinone-8, menaquinone, enterobactin, tetrahydrofolate (see respective enzymatic conversions of Group A sheet (and inputs thereto)), one or more of the polar uncharged amino acids (gly, ser, cys, homocysteine), isoleucine, methionine (see respective enzymatic conversions of Group B sheet (and inputs thereto)), glutamine, arginine, putrescine, spermidine, aminopropylcadaverine (see see respective enzymatic conversions of Group C sheet (and inputs thereto)), cadaverine (see respective enzymatic conversions of Group D sheet (and input thereto)), inosine-5-phosphate, xanthosine-5-phosphate, adenylo-succinate, orotidine-5'-phosphate, and any of the mono-, di-, and triphosphate nucleosides (i.e., adenosine, guanosine, cytosine, uridine) obtainable there from (see respective enzymatic conversions of Group E sheet (and input thereto)), glutamate, succinate, succinate semialdehyde, oxaloacetate, and aspartate (see respective enzymatic conversions of Group F sheet, including reactions shown along dashed lines), such that 3-HP tolerance thereby increases as a result of such genetic modification(s). Any portion or sub-portion may be selected for genetic modification(s) to increase 3-HP tolerance in a selected microorganism species.

As indicated, in various embodiments the combinations of genetic modifications as described in this section are practiced in combination with aspects of the invention pertaining to modulation of the fatty acid synthase system.

VIIIA. SCALES Technique

As described in WO 2010/011874, published Jan. 28, 2010, to obtain genetic information, initial 3-HP-related fitness data was obtained by evaluation of fitness of clones from a genomic-library population using the SCALES technique. These clones were grown in a selective environment imposed by elevated concentrations of 3-HP, shown to be a reliable test of 3-HP tolerance.

More particularly, to obtain data potentially useful to identify genetic elements relevant to increased 3-HP tolerance, an initial population of five representative *E. coli* K12 genomic libraries was produced by methods known to those skilled in the art. The five libraries respectively comprised 500, 1000, 2000, 4000, 8000 base pair ("bp") inserts of *E. coli* K12 genetic material. Each of these libraries, essentially comprising the entire *E. coli* K12 genome, was respectively transformed into MACH1™-T1® *E. coli* cells and cultured to mid-exponential phase corresponding to microaerobic conditions ($OD_{600}$~0.2). Batch transfer times were variable and were adjusted as needed to avoid a nutrient limited selection environment (i.e., to avoid the cultures from entering stationary phase). Although not meant to be limiting as to alternative approaches, selection in the presence of 3-HP was carried out over 8 serial transfer batches with a decreasing gradient of 3-HP over 60 hours. More particularly, the 3-HP concentrations were 20 g 3-HP/L for serial batches 1 and 2, 15 g 3-HP/L for serial batches 3 and 4, 10 g 3-HP/L for serial batches 5 and 6, and 5 g 3-HP/L for serial batches 7 and 8. For serial batches 7 and 8 the culture media was replaced as the culture approached stationary phase to avoid nutrient limitations.

Samples were taken during and at the culmination of each batch in the selection, and were subjected to microarray analysis that identified signal strengths. The individual standard laboratory methods for preparing libraries, transformation of cell cultures, and other standard laboratory methods used for the SCALES technique prior to array and data analyses are well-known in the art, such as supported by methods taught in Sambrook and Russell, Molecular Cloning: A Laboratory Manual, Third Edition 2001 (volumes 1-3), Cold Spring Harbor Laboratory Press, Cold Spring Harbor, N.Y. (hereinafter, Sambrook and Russell, 2001). Aspects of individual methods also are discussed in greater detail in the Examples and in the SCALES technique patent applications, U.S. Patent Publication No. 2006/0084098A1, filed Sep. 20, 2005, entitled: "Mixed-Library Parallel Gene Mapping Quantitation Microarray Technique for Genome Wide Identification of Trait Conferring Genes" (hereinafter, the "SCALES Technique"), which is incorporated herein by reference for teaching additional details of this technique.

Microarray technology also is well-known in the art (see, e.g. <<www.affymetrix.com>>). To obtain data of which clones were more prevalent at different exposure periods to 3-HP, Affymetrix *E. coli* Antisense Gene Chip arrays (Affymetrix, Santa Clara, Calif.) were handled and scanned according to the *E. coli* expression protocol from Affymetrix producing affymetrix.cel files. A strong microarray signal after a given exposure to 3-HP indicates that the genetic sequence introduced by the plasmid comprising this genetic sequence confers 3-HP tolerance. These clones can be identified by numerous microarray analyses known in the art.

Also, for the purposes of incorporation by reference as applied in the United States, "A genomics approach to improve the analysis and design of strain selections," T. E. Warnecke et al., Metabolic Engineering 10 (2008)154-165, is incorporated by reference herein for its additional specific teachings that demonstrate that SCALEs fitness data correlates with and can be used as a surrogate of increased tolerance to 3-HP. This conclusion is based on the standard use of a receiver operator characteristic curve (ROC) curve. ROC analysis is routinely used in the medical diagnostic field to evaluate the correlation for a diagnostic test to the actual presence or absence of a disease. Currently diagnostic tests used through the world in medical applications that perform well in a ROC analysis are routinely used to identify the absence or presence of a disease. This analysis was adapted to evaluate the sensitivity and specificity of different microbial growth based selections resulting in fitness values as reliable tests for 3-HP tolerance. In particular a growth based selection using serial batch cultures with decreasing levels of 3-HP was identified as a sensitive and specific test for 3-HP tolerance. As a result clones in this selection with a fitness metric greater than a cutoff of 0 are identified as clones conferring tolerance to 3-HP.

The following table lists some of the genes (introduced by vectors of the libraries) that were shown to have elevated fitness values, shown herein to confer tolerance to 3-HP.

TABLE 3

SCALES Fitness Data

| Gene | Cumulative Fitness | Gene | Cumulative Fitness | Gene | Cumulative Fitness |
|---|---|---|---|---|---|
| aceE | 11.2 | cysM | 26.63 | ilvC | 2.61 |
| aceF | 8.39 | eno | 6.98 | ilvD | 1.6 |
| ackA | 2.36 | entA | 1.58 | ilvE | 0.94 |
| acnA | 3.58 | entB | 0.93 | ilvH | 1.18 |
| acnB | 3.18 | entC | 1.26 | ilvI | 1.77 |
| adhE | 3.68 | entD | 1 | ilvM | 1.02 |
| adiA | 1.95 | entE | 1.03 | ilvN | 1.53 |
| adk | 2.18 | entF | 1.03 | kbl | 3.11 |
| aldA | 1.83 | fbaA | 2.87 | itaE | 1.14 |
| argA | 3.94 | fbaB | 2.28 | lysC | 1.97 |
| argB | 8.94 | folA | 15.07 | malY | 2.58 |
| argC | 4.02 | folB | 0.57 | menA | 3.2 |
| argD | 2.87 | folC | 1.72 | menB | 0.86 |
| argE | 2.15 | folD | 8.54 | menC | 0.92 |
| argF | 2.04 | folE | 1.08 | menD | 2.33 |
| argG | 2.62 | folK | 1.73 | menE | 3.06 |
| argH | 8.06 | folP | 2.45 | menF | 3.09 |
| argI | 4.06 | fumA | 3.84 | metA | 1.56 |
| aroA | 2.31 | fumB | 2.51 | metB | 1.83 |
| aroB | 8.68 | fumC | 1.86 | metC | 6.08 |
| aroC | 1.95 | gabD | 1.83 | metE | 2.46 |
| aroD | 1.93 | gabT | 1.41 | metH | 2.44 |
| aroE | 8.44 | gapA | 3.03 | metK | 3.35 |
| aroF | 6.24 | gcvH | 5.9 | metL | 2.97 |
| aroG | 2.26 | gcvP | 7.91 | mhpF | 1.44 |
| aroH | 1.61 | gcvT | 1.78 | ndk | 1.66 |
| aroK | 4 | gdhA | 2.84 | nrdA | 2.01 |
| aroL | 1.63 | gldA | 2.08 | nrdB | 1.81 |
| asd | 2.96 | glk | 1.17 | nrdD | 2.79 |
| aspC | 2.82 | glnA | 1.34 | nrdE | 1.91 |
| astC | 2.29 | gltA | 6.37 | nrdF | 1.25 |
| carA | 0.89 | glyA | 5.06 | pabA | 2.33 |
| carB | 1.17 | gmk | 1.86 | pabB | 1.92 |
| cynS | 4.83 | gnd | 1.69 | thrA | 2.79 |
| cysE | 1.19 | gpmA | 2.01 | thrB | 0.96 |
| cysK | 2.41 | guaA | 3.65 | thrC | 1.51 |
| pabC | 1.75 | guaB | 2.63 | pheA | 6.7 |
| pfkA | 1.78 | ilvA | 12.21 | pta | 2.7 |
| pflB | 2.83 | ilvB | 2.7 | purA | 5.1 |
| purB | 3.65 | rpiA | 1.85 | trpC | 1.56 |
| purC | 1.78 | sdaA | 1.62 | trpD | 2.48 |

TABLE 3-continued

SCALES Fitness Data

| Gene | Cumulative Fitness | Gene | Cumulative Fitness | Gene | Cumulative Fitness |
|---|---|---|---|---|---|
| purD | 1.32 | sdaB | 1.22 | trpE | 2.85 |
| purE | 1.82 | serA | 3.11 | tynA | 2.36 |
| purF | 2.04 | serB | 2.46 | tyrA | 9.1 |
| purH | 1.66 | serC | 2.15 | tyrB | 1.49 |
| purK | 2.65 | speA | 2.09 | ubiA | 1.51 |
| purL | 4.83 | speB | 1.66 | ubiB | 2.09 |
| purM | 3.13 | speC | 1.52 | ubiC | 2.4 |
| purN | 2.94 | speD | 3.43 | ubiD | 0.91 |
| purT | 3.73 | talA | 1.24 | ubiE | 1.02 |
| puuE | 1.53 | talB | 4.78 | ubiF | 1.78 |
| pyrB | 6.36 | tdcB | 1.87 | ubiG | 3.17 |
| pyrC | 14.48 | tdcD | 1.64 | ubiH | 5.35 |
| pyrD | 2.26 | tdcE | 1.16 | ubiX | 1.72 |
| pyrE | 1.03 | tdh | 1.38 | ydcW | 0.89 |
| pyrF | 1.38 | tktA | 1.89 | ydiB | 0.87 |
| pyrG | 2.23 | tktB | 1.21 | ygjG | 2.51 |
| pyrH | 1.78 | trpA | 2.45 | yneI/sad | 4.18 |
| pyrI | 0.83 | trpB | 1.93 | | |
| rpe | 2.06 | | | | |

VIIIB. Analysis of the SCALES Technique

Also as described in WO 2010/011874, published Jan. 28, 2010, analysis of the 3-HP tolerance SCALEs data has led to an understanding of interrelationships among various identified pathways and portions thereof. It is noted that the 3HPTGC, in its entirety, was deduced from interrelationships between genes having elevated fitness values. Not every enzyme of the 3HPTGC was shown in the SCALES data to have positive fitness values. This may be attributed to certain deficiencies in the commercial arrays used to obtain that SCALES data. Accordingly, some members of the E. coli 3HPTGC not so derived from the SCALES genetic element data were deduced to fill in the 3HPTGC. However, it is noted that most of the enzymes in the 3HPTGC do have positive fitness values, and the overall fitness data in combination with the supplements and genetic modifications data, provided herein, prove the validity of the deduction and the overall significance of the 3HPTGC being related to 3-HP tolerance.

As described herein, the 3HPTGC is divided into an "upper section" comprising the glycolysis pathway, the tricarboxylic acid cycle, the glyoxylate pathway, and a portion of the pentose phosphate pathway, and a "lower section" comprising all or portions of the chorismate super-pathway, the carbamoyl-phosphate to carbamate pathway, the threonine/homocysteine super-pathway, the nucleotide synthesis pathway, and the polyamine synthesis pathway.

In various embodiments microorganisms are genetically modified to affect one or more enzymatic activities of the 3HPTGC so that an elevated tolerance to 3-HP may be achieved, such as in industrial systems comprising microbial 3-HP biosynthetic activity. Also, genetic modifications may be made to provide and/or improve one or more 3-HP biosynthesis pathways in microorganisms comprising one or more genetic modifications for the 3-HP toleragenic complex, thus providing for increased 3-HP production. These latter recombinant microorganisms may be referred to as 3-HP-syntha-toleragenic recombinant microorganisms ("3HPSATG" recombinant microorganisms).

The 3HPTGC for E. coli is disclosed in FIG. 9A, sheets 1-7 (a guide for positioning these sheets to view the entire depicted 3HPTGC is provided in sheet 1 of FIG. 9A). As may be observed in FIG. 9, sheets 1-7, the 3HPTGC comprises all or various indicated portions of the following: the chorismate super-pathway, the carbamoyl-phosphate to carbamate pathway, the threonine/homocysteine super-pathway; a portion of the pentose phosphate pathway; the nucleotide synthesis pathway; the glycolysis/tricarboxylic acid cycle/glyoxylate bypass super-pathway; and the polyamine synthesis pathway. It is noted that the chorismate pathway and the threonine pathway are identified as super-pathways since they respectively encompass a number of smaller known pathways. However, the entire 3HPTGC comprises these as well as other pathways, or portions thereof, that normally are not associated with either the chorismate super-pathway or the threonine/homocysteine super-pathway.

More particularly, FIG. 9A, comprising sheets 1-7, is subdivided into the lower section, which is further subdivided into Groups A-E and the upper section, identified simply as Group F. The lower section groups are identified as follows: Group A, or "chorismate," comprising the indicated, major portion of the chorismate super-pathway (sheet 3); Group B, or "threonine/homocysteine," comprising the indicated portion of the threonine/homocysteine pathway (sheet 7); Group C, or "polyamine synthesis," comprising the indicated portion of the polyamine pathway, which includes arginine synthesis steps and also the carbamoyl-phosphate to carbamate pathway (sheet 5); Group D, or "lysine synthesis," comprising the indicated portion of the lysine synthesis pathway (sheet 6); Group E, or "nucleotide synthesis," comprising the indicated portions of nucleotide synthesis pathways (sheet 4). Group F (sheet 2) comprises the upper section of the 3HPTGC and includes the glycolysis pathway, the tricarboxylic acid cycle, and the glyoxylate bypass pathway, and the indicated portions of the pentose phosphate pathway.

It is noted that particular genes are identified at enzymatic conversion steps of the 3HPTGC in FIG. 9A, sheets 1-7. These genes are for $E.\ coli$ strain K12, substrain MG1655; nucleic acid and corresponding amino acid sequences of these are available at <<http://www.ncbi.nlm.nih.gov/sites/entrez>>, and alternatively at <<www.ecocyc.org>>. As is known to one skilled in the art, some genes may be found on a chromosome within an operon, under the control of a single promoter, or by other interrelationships. When a nucleic acid sequence herein is referred to as a combination, such as sucCD or cynTS, by this is meant that the nucleic acid sequence comprises, respectively, both sucC and sucD, and both cynT and cynS. Additional control and other genetic elements may also be in such nucleic acid sequences, which may be collectively referred to as "genetic elements" when added in a genetic modification, and which is intended to include a genetic modification that adds a single gene.

However, similarly functioning genes are readily found in different species and strains, encoding enzymes having the same function as shown in FIG. 9A, sheets 1-7, and such genes, and the 3HPTGCs of such other species and strains may be utilized in the practice of the invention. This can be achieved by the following methods, which are not meant to be limiting.

For the set of genes within the 3HPTGC of $E.\ coli$, protein sequences were obtained from NCBI. To identify similarly functioning genes in $S.\ cerevisiae$, a pathway comparison tool at <<www.biocyc.org>> was utilized using the genes identified in the $E.\ coli$ 3HPTGC. For $B.\ subtilis$, this annotated approach was used in part, and enzymes or pathway portions not obtained by that approach were obtained by a homology comparison approach. For the homology approach, a local blast (<<www.ncbi.nlm.nih.gov/Tools/>>) (blastp) comparison using the selected set of $E.\ coli$ proteins and $Bacillus$ protein sequence (4096 sequences) was performed using different thresholds (<<www.ncbi.nlm.nih.gov/genomes/lproks.cgi>>). Using the homology information (homology matches having $E^{-10}$ or less E-value) the remaining genes and enzymes were identified for the 3HPTGC for $Bacillus\ subtilis$.

Also, the latter homology approach was used for $Cupriavidus\ necator$, the following table provides some examples of the homology relationships for genetic elements of $C.\ necator$ that have a demonstrated homology to $E.\ coli$ genes that encode enzymes known to catalyze enzymatic conversion steps of the 3HPTGC. This is based on the criterion of the homologous sequences having an E-value less than $E^{10}$. The table provides only a few of the many homologies (over 850) obtained by the comparison. Not all of the homologous sequences in $C.\ necator$ are expected to encode a desired enzyme suitable for an enzymatic conversion step of the 3HPTGC for $C.\ necator$. However, through one or more of a combination of selection of genetic elements known to encode desired enzymatic reactions, the most relevant genetic elements are selected for the 3HPTGC for this species.

TABLE 4

Homology Relationships for Genetic Elements of $C.\ necator$

| E. coli Gene Symbol | E. coli enzyme product | E. coli enzyme substrate | C. necator Gene Symbol | C. necator E-value | C. necator Gene Product |
|---|---|---|---|---|---|
| acee | Pyruvate | acetyl-coA | aceE | 0 | pyruvate dehydrogenase subunit E1 |
| acee | Pyruvate | acetyl-coA | aceE | 0 | pyruvate dehydrogenase subunit E1 |
| acee | Pyruvate | acetyl-coA | aceE | 0 | 2-oxoacid dehydrogenase subunit E1 |
| acef | gi\|16128108\|ref\|NP_414 657.1\| | pyruvate | pdhB | 2.00E−102 | dihydrolipoamide acetyltransferase |
| acef | gi\|16128108\|ref\|NP_414 657.1\| | pyruvate | pdhB | 2.00E−25 | dihydrolipoamide acetyltransferase |
| acef | Pyruvate | acetyl-coA | pdhB | 2.00E−22 | dihydrolipoamide acetyltransferase |
| acef | Pyruvate | acetyl-coA | pdhB | 1.00E−10 | dihydrolipoamide acetyltransferase |

TABLE 4-continued

Homology Relationships for Genetic Elements of *C. necator*

| E. coli Gene Symbol | E. coli enzyme product | E. coli enzyme substrate | C. necator Gene Symbol | C. necator E-value | C. necator Gene Product |
|---|---|---|---|---|---|
| acef | Pyruvate | acetyl-coA | pdhL | 6.00E−11 | dihydrolipoamide dehydrogenase (E3) component of pyruvate dehydrogenase |
| acef | Pyruvate | acetyl-coA | pdhL | 2.00E−09 | dihydrolipoamide dehydrogenase (E3) component of pyruvate dehydrogenase |
| acef | Pyruvate | acetyl-coA | pdhL | 8.00E−08 | dihydrolipoamide dehydrogenase (E3) component of pyruvate dehydrogenase |
| acef | Pyruvate | acetyl-coA | odhB | 9.00E−36 | dihydrolipoamide acetyltransferase |
| acef | Pyruvate | acetyl-coA | bkdB | 1.00E−30 | branched-chain alpha-keto acid dehydrogenase subunit E2 |
| acef | Pyruvate | acetyl-coA | bkdB | 1.00E−07 | branched-chain alpha-keto acid dehydrogenase subunit E2 |
| acef | Pyruvate | acetyl-coA | bkdB | 2.00E−07 | branched-chain alpha-keto acid dehydrogenase subunit E2 |
| acna | gi|16129237|ref|NP_415792.1| | citrate | leuC1 | 2.00E−19 | isopropylmalate isomerase large subunit |
| acna | gi|16129237|ref|NP_415792.1| | citrate | leuC2 | 7.00E−22 | isopropylmalate isomerase large subunit |
| acna | gi|16129237|ref|NP_415792.1| | citrate | acnM | 0 | aconitate hydratase |
| acna | gi|16129237| ref |NP_415792.1| | citrate | leuC3 | 6.00E−20 | isopropylmalate isomerase large subunit |
| acna | Citrate | cis-aconitate | acnA | 0 | aconitate hydratase |
| acna | Citrate | cis-aconitate | leuC4 | 6.00E−14 | 3-isopropylmalate dehydratase large subunit |
| acna | Citrate | cis-aconitate | leuC5 | 1.00E−12 | isopropylmalate isomerase large subunit |
| . . . | | | | | |
| ytjc | gi|16132212|ref|NP_418812.1| | 3-phospho-glycerate | pgam2 | 3.00E−25 | phosphoglycerate mutase 2 protein |
| ytjc | 3-phosphoglycerate | 2-phospho-glycerate | pgam2 | 3.00E−25 | phosphoglycerate mutase 2 protein |
| zwf | gi|16129805|ref|NP_416366.1| | glucose-6-phosphate | zwf1 | 2.00E−132 | glucose-6-phosphate 1-dehydrogenase |
| zwf | glucose-6-phosphate | glucono-lactone-6-phosphate | zwf2 | 7.00E−126 | glucose-6-phosphate 1-dehydrogenase |
| zwf | glucose-6-phosphate | glucono-lactone-6-phosphate | zwf3 | 8.00E−130 | glucose-6-phosphate 1-dehydrogenase |

FIG. 9B, sheets 1-7, shows the 3HPTGC for *Bacillus subtilis*, FIG. 9C, sheets 1-7, shows the 3HPTGC for the yeast *Saccharomyces cerevisiae* and FIG. 9D, sheets 1-7, shows the 3HPTGC for *Cupriavidus necator*. Enzyme names for the latter are shown, along with an indication of the quantity of homologous sequences meeting the criterion of having an E-value less than $E^{-10}$ when compared against an *E. coli* enzyme known to catalyze a desired 3HPTGC enzymatic conversion step.

Based on either of the above approaches, and the present existence of or relative ease and low cost of obtaining genomic information of a given microorganism species, one or both of the above approaches may be employed to identify relevant genes and enzymes in a selected microorganism species (for which its genomic sequence is known or has been obtained), evaluate the relative improvements in 3-HP tolerance of selected genetic modifications of such homologously matched and identified genes, and thereby produce a recombinant selected microorganism comprising improved tolerance to 3-HP.

Additionally, it is appreciated that alternative pathways in various microorganisms may yield products of the 3HPTGC, the increased production or presence of which are demonstrated herein to result in increased 3-HP tolerance. For example, in yeast species there are alternative pathways to lysine, a product within Group D. Accordingly, alterations of such alternative pathways are within the scope of the invention for such microorganism species otherwise falling within the scope of the relevant claim(s). Thus, in various embodiments the invention is not limited to the specific pathways depicted in FIGS. 9A-D. That is, various pathways, and enzymes thereof, that yield the products shown in FIGS. 9A-D may be considered within the scope of the invention.

It is noted that when two or more genes are shown for a particular enzymatic conversion step, these may be components of a single multi-enzyme complex, or may represent alternative enzymes that have different control factors that control them, or are induced differently. Also, as is clear to one skilled in the art, the major reactants (i.e., substrates) and products are shown for the enzymatic conversion steps. This is to minimize details on an already-crowded figure. For example, electron carriers and energy transfer molecules, such as NAD(P)(H) and ADP/ATP, are not shown, and these (and other small-molecule reactants not shown in the 3HPTGC figures) are not considered "products" of the 3HPTGC as that term is used herein. Also, for at least two steps (dihydroneopterin phosphate to 7,8-dihydro-D-neopterin and 1,4-dihydroxy-2-naphthoyl-CoA to 1,4-dihydroxy-2-naphthoate) no enzyme is shown because no enzyme has been known to be identified for this step at the time of filing. Accordingly, in some embodiments the 3HPTGC is understood and/or taken to exclude enzymes, nucleic acid sequences, and the like, for these steps. Also, as discussed herein, also included within the scope of the invention are nucleic acid sequence variants encoding identified enzymatic functional variants of any of the enzymes of the 3HPTGC or a related complex or portion thereof as set forth herein, and their use in constructs, methods, and systems claimed herein.

Figure 10:
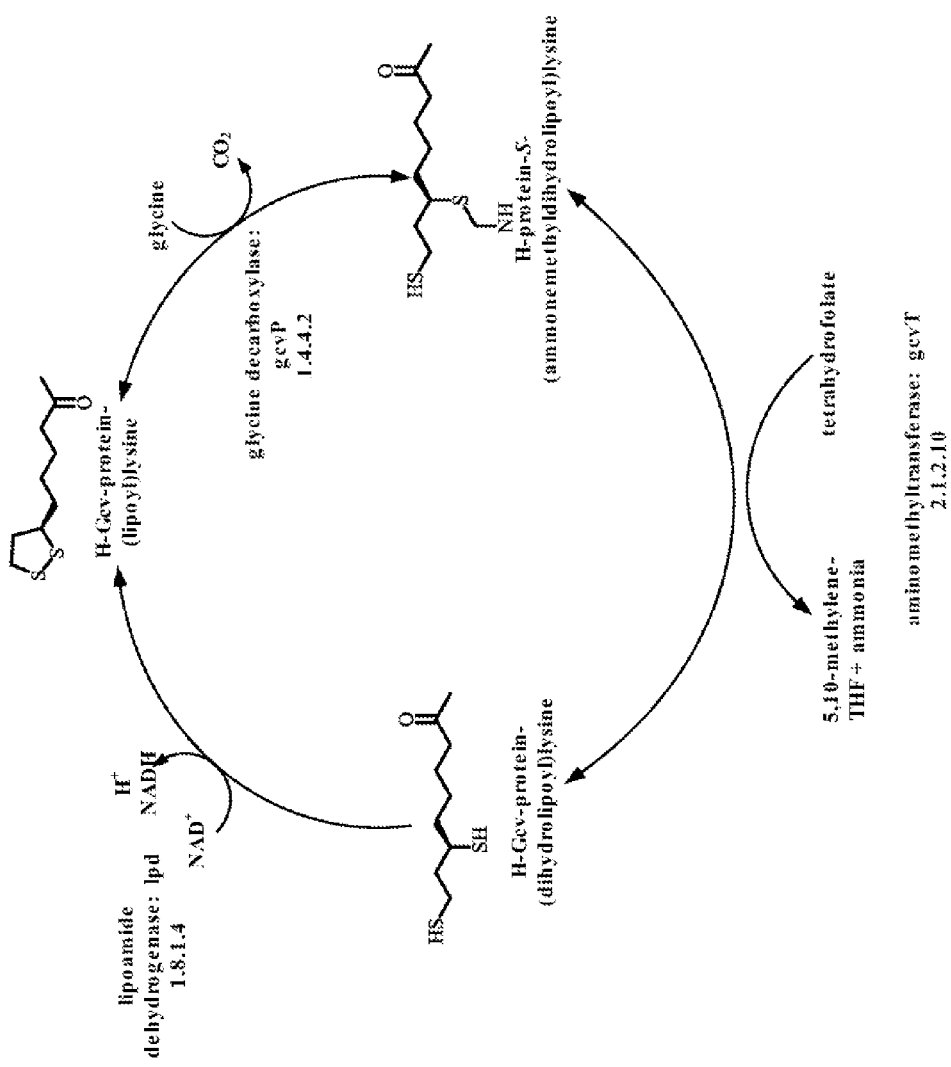
FIG. 10 provides a representation of the glycine cleavage pathway.
Figure 11:
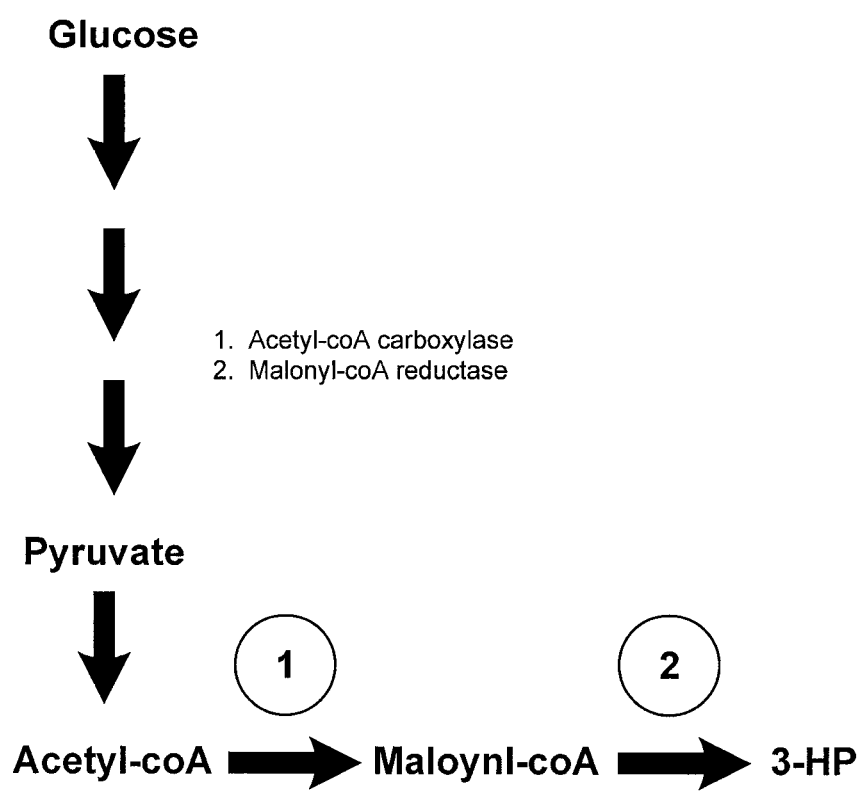
FIG. 11 provides, from a prior art reference, a summary of a known 3-HP production pathway from glucose to pyruvate to acetyl-CoA to malonyl-CoA to 3-HP.
Figure 12:
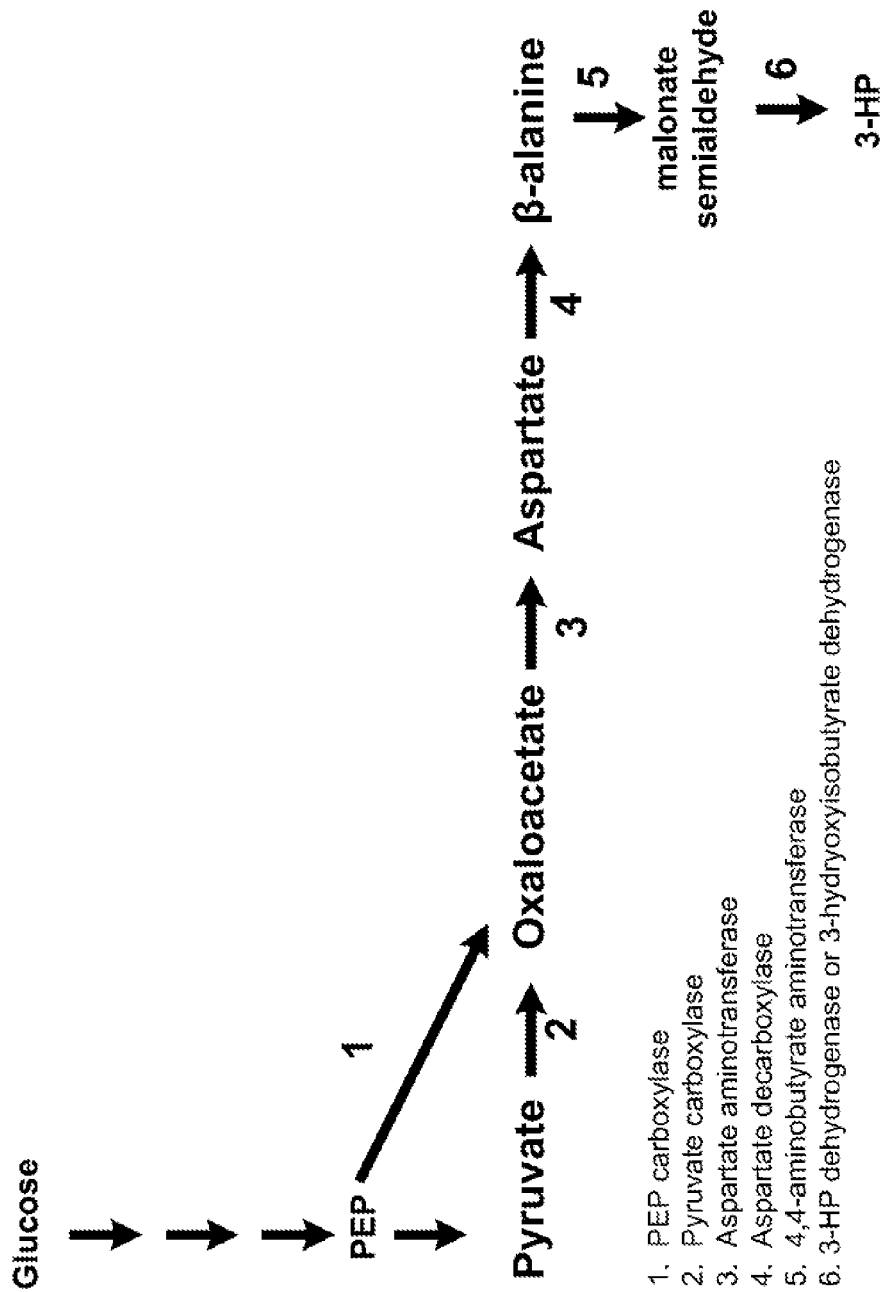
FIG. 12 provides, from a prior art reference, a summary of a known 3-HP production pathway from glucose to phospho-enolpyruvate (PEP) to oxaloacetate (directly or via pyruvate) to aspartate to β-alanine to malonate semialdehyde to 3-HP.

Some fitness data provided in Table 3 is not represented in the figures of the 3HPTGC but nonetheless is considered to support genetic modification(s) and/or supplementation to improve 3-HP tolerance. For example, the relatively elevated fitness scores for gcvH, gcvP and gcvT, related to the glycine cleavage system. These enzymes are involved in the glycine/5,10-methylene-tetrahydrofolate ("5,10 mTHF") conversion pathway, depicted in FIG. 10. In the direction shown in FIG. 10, the three enzymatically catalyzed reactions result in decarboxylation of glycine (a 3HPTGC product, see FIG. 9A, sheet 4), production of 5,10-methylene-THF from tetrahyrdofolate ("THF"), and production of NADH from $NAD^+$. The 5,10-methylene-THF product of this complex is a reactant in enzymatically catalyzed reactions that are part of the following: folate polyglutamylation; panthothenate biosynthesis; formylTHF biosynthesis; and de novo biosynthesis of pyrimidine deoxyribonucleotides. Overall, genetic modifications in a microorganism directed to the enzymes, and enzymatic catalytic steps thereof, shown in Table 3 but not represented in FIG. 9, sheets 1-7 are considered part of the invention (as are their functional equivalents for other species), wherein such genetic modifications result in an increase in 3-HP tolerance.

VIIIC. Genetic Modifications and Supplementations of the 3HPTCG

For various embodiments of the invention the genetic modifications to any pathways and pathway portions of the 3HPTCG and any of the 3-HP bio-production pathways may be described to include various genetic manipulations, including those directed to change regulation of, and therefore ultimate activity of, an enzyme, or enzymatic activity of an enzyme identified in any of the respective pathways. Such genetic modifications may be directed to transcriptional, translational, and post-translational modifications that result in a change of enzyme activity and/or overall enzymatic conversion rate under selected and/or identified culture conditions, and/or to provision of additional nucleic acid sequences (as provided in some of the Examples) so as to increase copy number and/or mutants of an enzyme of the 3HPTGC.

Specific methodologies and approaches to achieve such genetic modification are well known to one skilled in the art, and include, but are not limited to: increasing expression of an endogenous genetic element; decreasing functionality of a repressor gene; introducing a heterologous genetic element; increasing copy number of a nucleic acid sequence encoding a polypeptide catalyzing an enzymatic conversion step of the 3HPTGC; mutating a genetic element to provide a mutated protein to increase specific enzymatic activity; over-expressing; under-expressing; over-expressing a chaperone; knocking out a protease; altering or modifying feedback inhibition; providing an enzyme variant comprising one or more of an impaired binding site for a repressor and/or competitive inhibitor; knocking out a repressor gene; evolution, selection and/or other approaches to improve mRNA stability. Random mutagenesis may be practiced to provide genetic modifications of the 3HPTGC that may fall into any of these or other stated approaches. The genetic modifications further broadly fall into additions (including insertions), deletions (such as by a mutation) and substitutions of one or more nucleic acids in a nucleic acid of interest. In various embodiments a genetic modification results in improved enzymatic specific activity and/or turnover number of an enzyme. Without being limited, changes may be measured by one or more of the following: $K_M$; $K_{cat}$; and $K_{avidity}$.

Such genetic modifications overall are directed to increase enzymatic conversion at least one enzymatic conversion step of the 3HPTGC so as to increase 3-HP tolerance of a microorganism so modified. Also, the enzymatic conversion steps shown in FIGS. 9A-D may be catalyzed by enzymes that are readily identified by one skilled in the art, such as by searching for the enzyme name corresponding to the gene name at a particular enzymatic conversion step in FIGS. 9A-D, and then identifying enzymes, such as in other species, having the same name and function. The latter would be able to convert the respective reactant(s) to the respective product(s) for that enzymatic conversion step. Public database sites, such as <<www.metacyc.org>>, <<www.ecocyc.org>>, <<www.biocyc.org>>, and <<www.ncbi.gov>>, have associated tools to identify such analogous enzymes.

Also, although the MIC analysis is used frequently herein as an endpoint to indicate differences in microorganism growth when placed in various 3-HP concentrations for a specified time, this is by no means considered to be the only suitable metric to determine a difference, such as an improvement, in microorganism tolerance based on aspects of the invention. Without being limiting, other suitable measurement approaches may include growth rate determination, lag time determination, changes in optical density of cultures at specified culture durations, number of doublings of a population in a given time period and, for microorganisms that comprise 3-HP production capability, overall 3-HP production in a culture system in which 3-HP accumulates to a level inhibitory to a control microorganism lacking genetic modifications that increase enzymatic conversion at one or more enzymatic conversion steps of the 3HPTGC. This may result in increased productivities, yields or titers.

It is generally appreciated that a useful metric to assess increases in 3-HP tolerance can be related to a microorganism's or a microorganism culture's ability to grow while exposed to 3-HP over a specified period of time. This can be determined by various quantitative and/or qualitative analyses and endpoints, particularly by comparison to an appropriate control that lacks the 3-HP tolerance-related genetic modification(s) and/or supplements as disclosed and discussed herein. Time periods for such assessments may be, but are not limited to: 12 hours; 24 hours; 48 hours; 72 hours; 96 hours; and periods exceeding 96 hours. Varying exposure concentrations of 3-HP may be assessed to more clearly identify a 3-HP tolerance improvement. The following paragraphs provide non-limiting examples of approaches that may be used to demonstrate differences in a microorganism's ability to grow and/or survive in the presence of 3-HP in its culture system when teachings of the present invention are applied to the microorganism and/or the culture system.

Figure 15A:
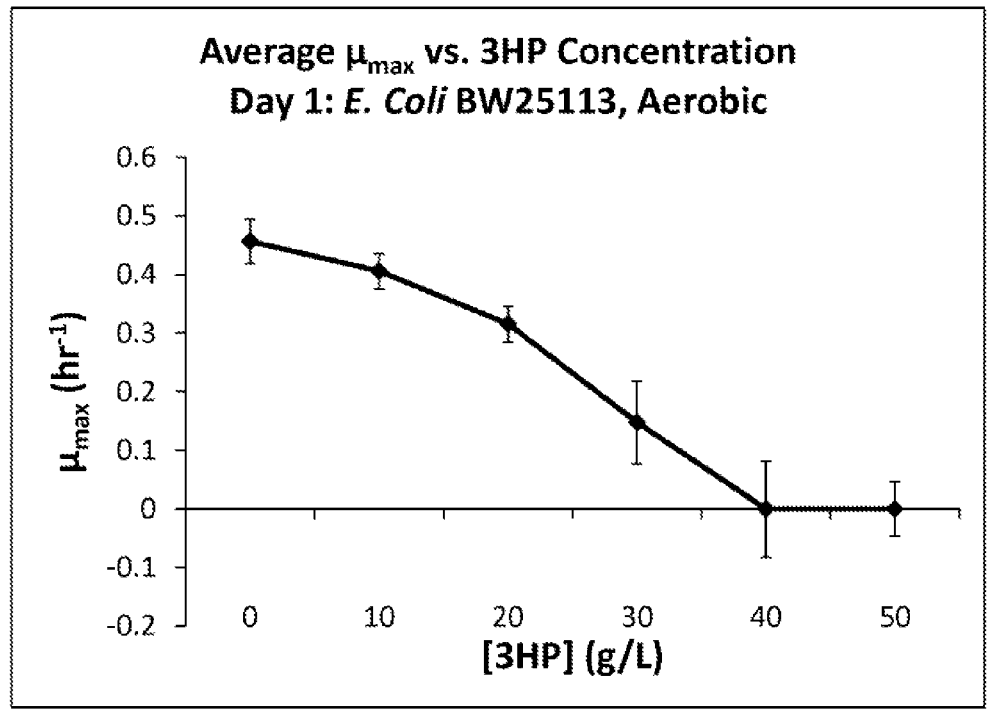
FIG. 15A-O provides graphic data of control microorganisms responses to 3-HP, and FIG. 15P provides a comparison with one genetic modification of the 3HPTGC.
Figure 15B:
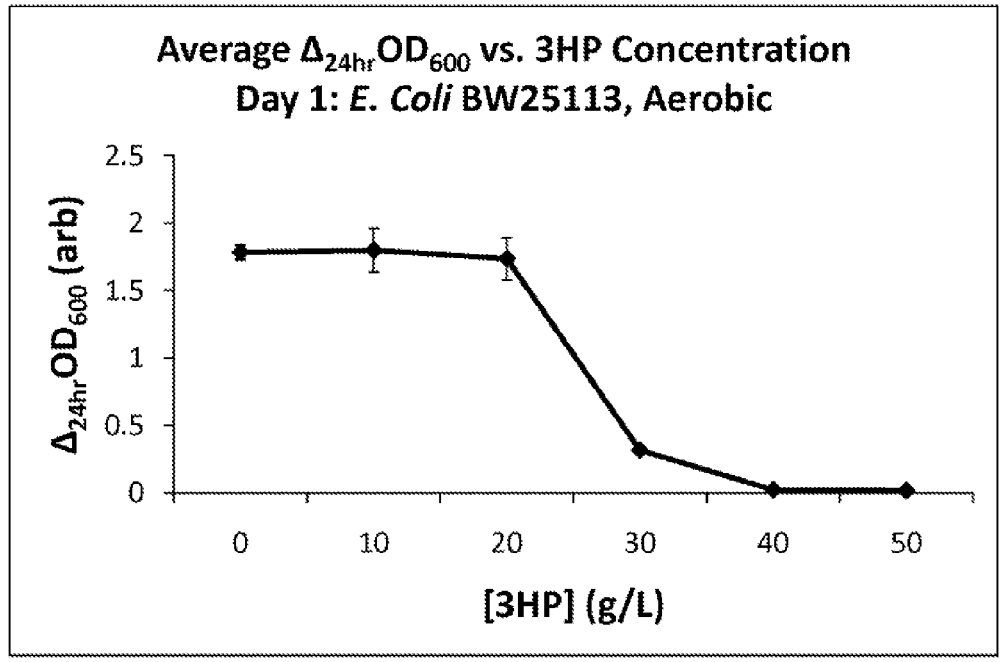
Figure 15C:
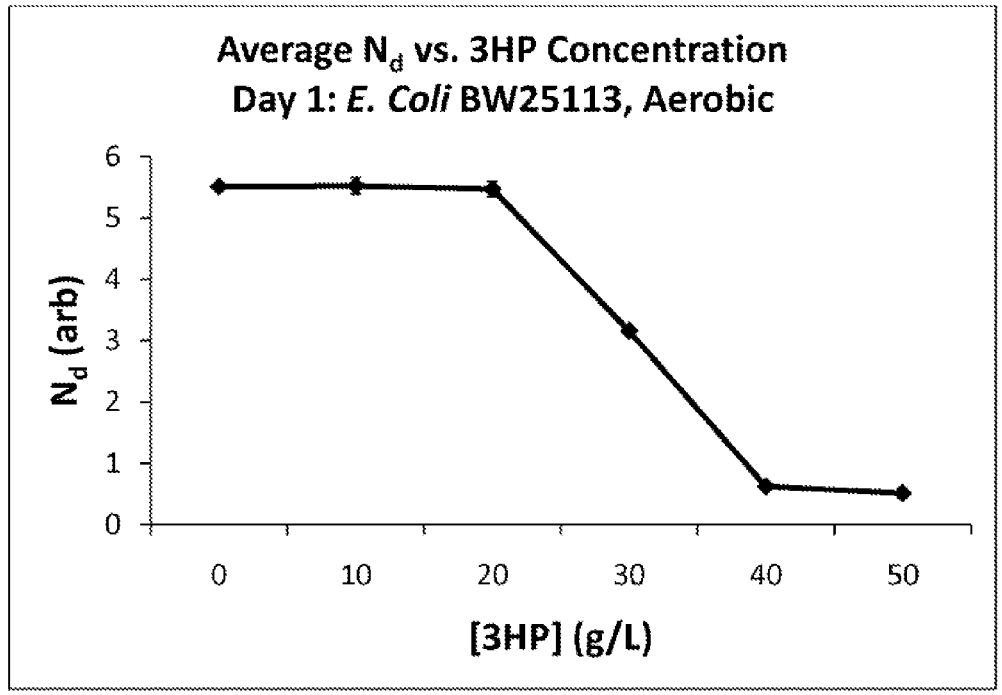
Figure 15D:
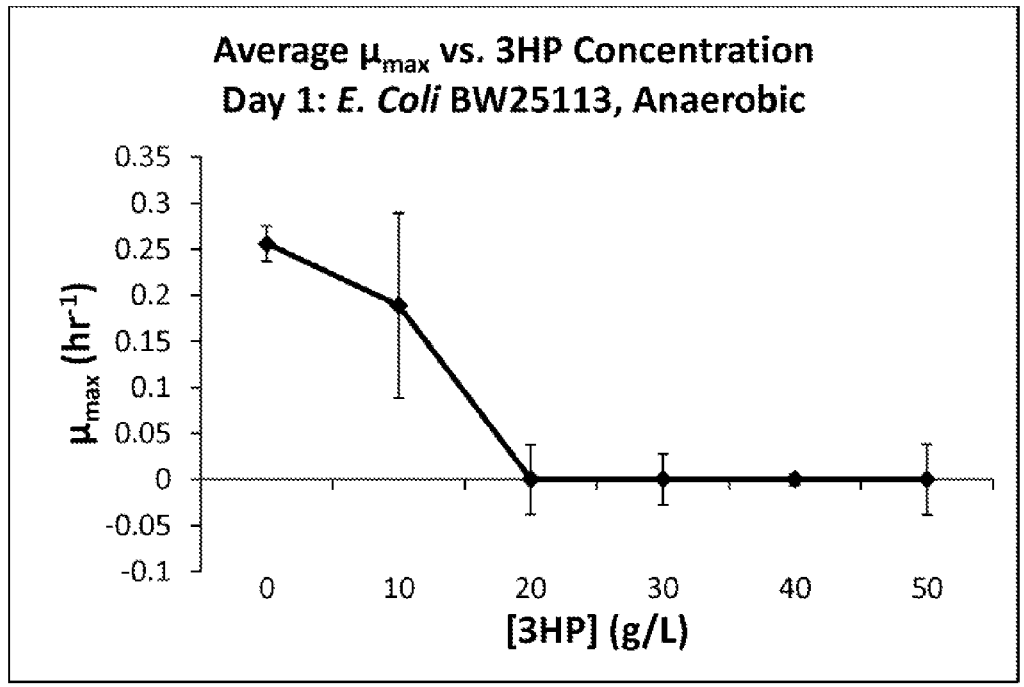
Figure 15E:
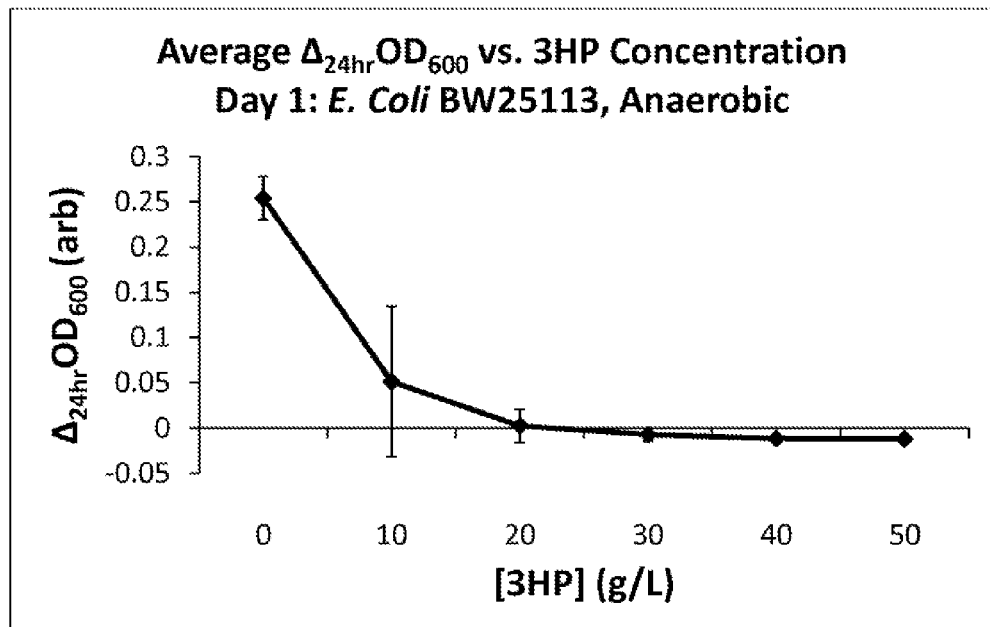
Figure 15F:
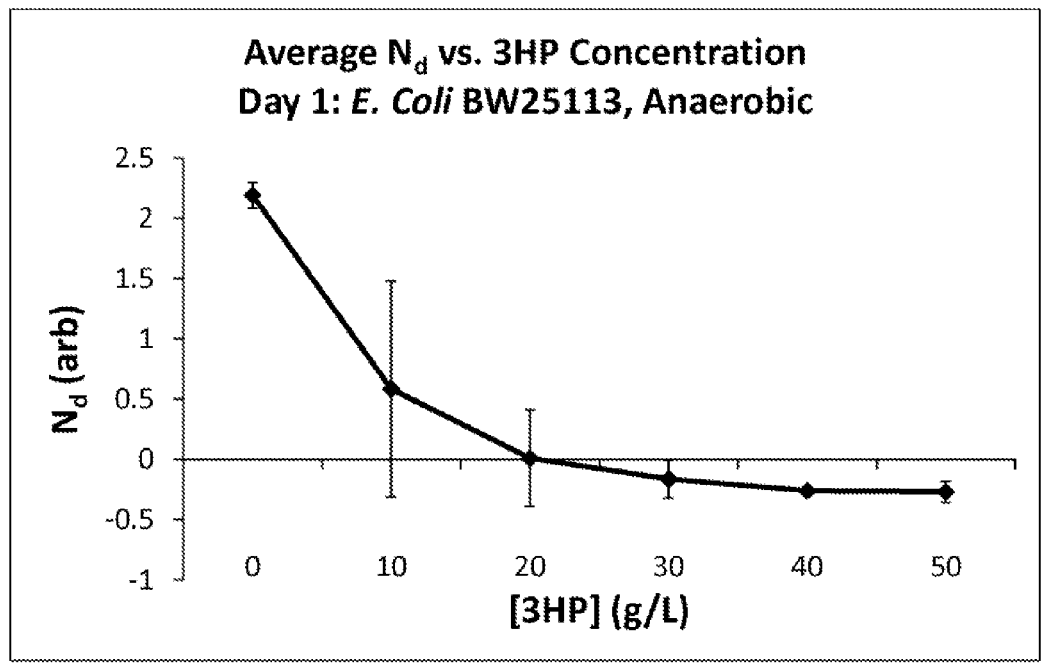
Figure 15G:
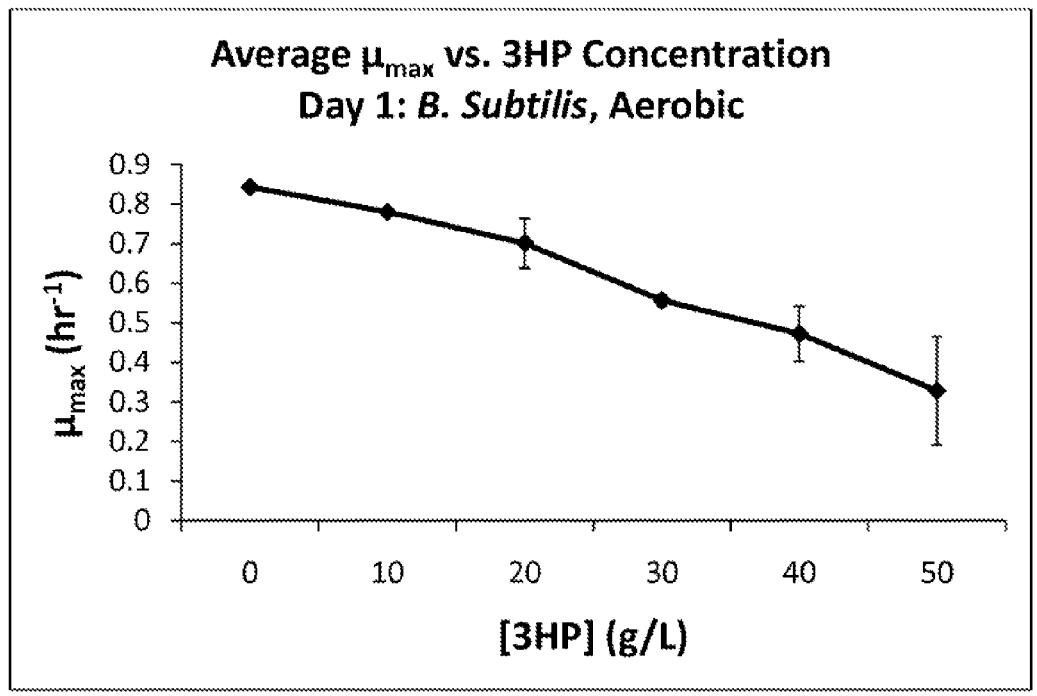
Figure 15H:
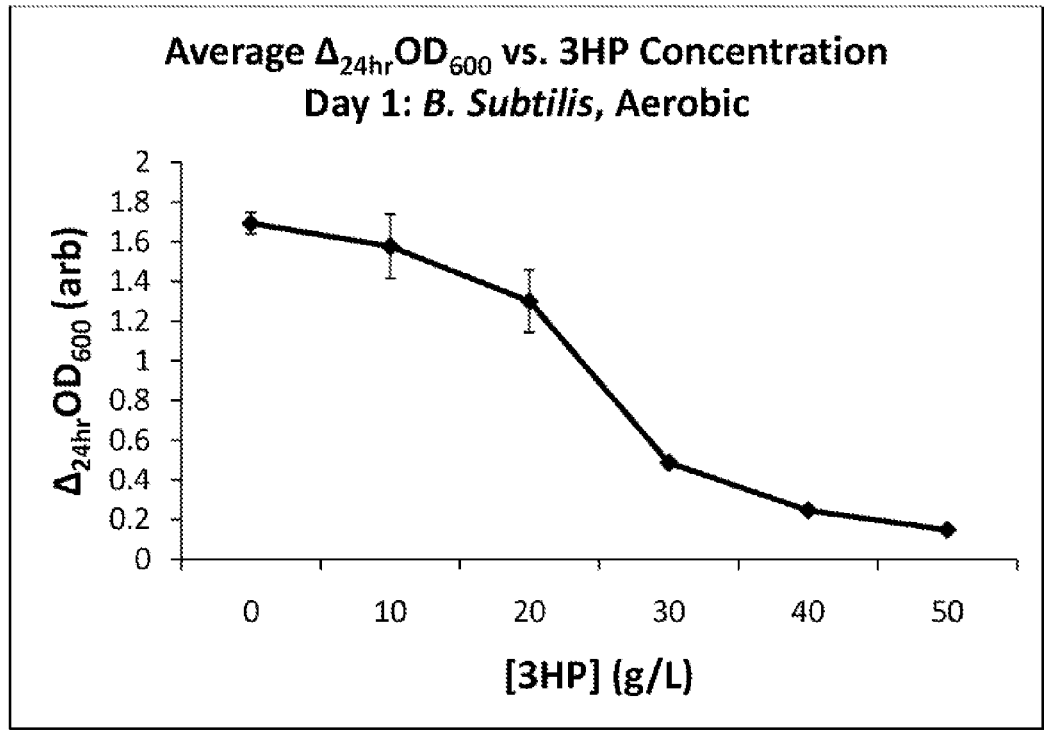
Figure 15I:
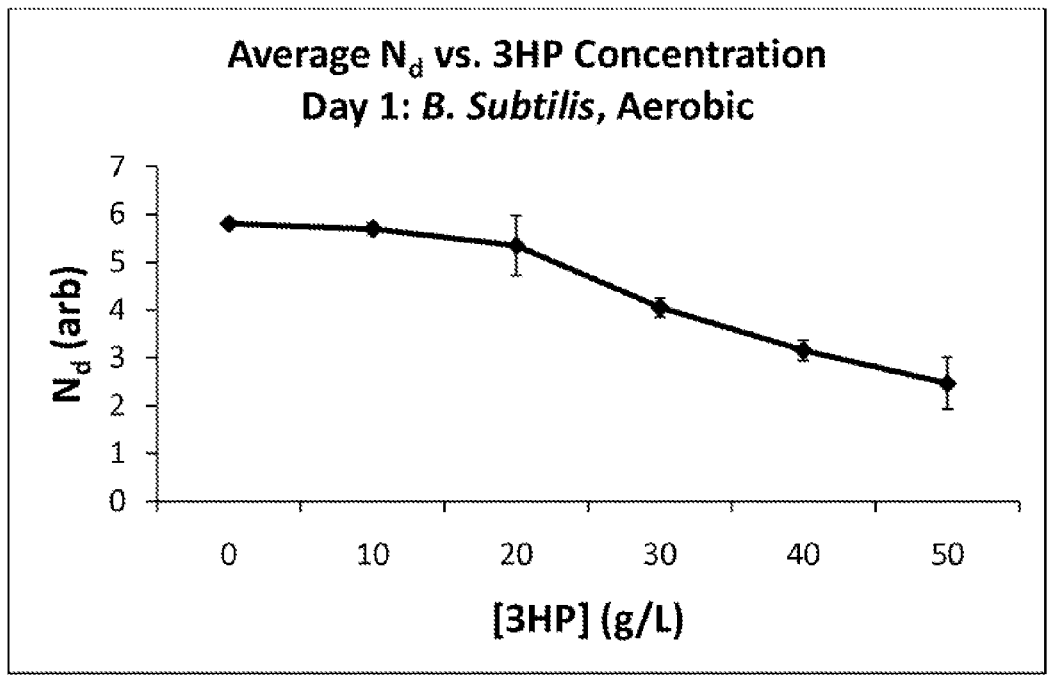
Figure 15J:
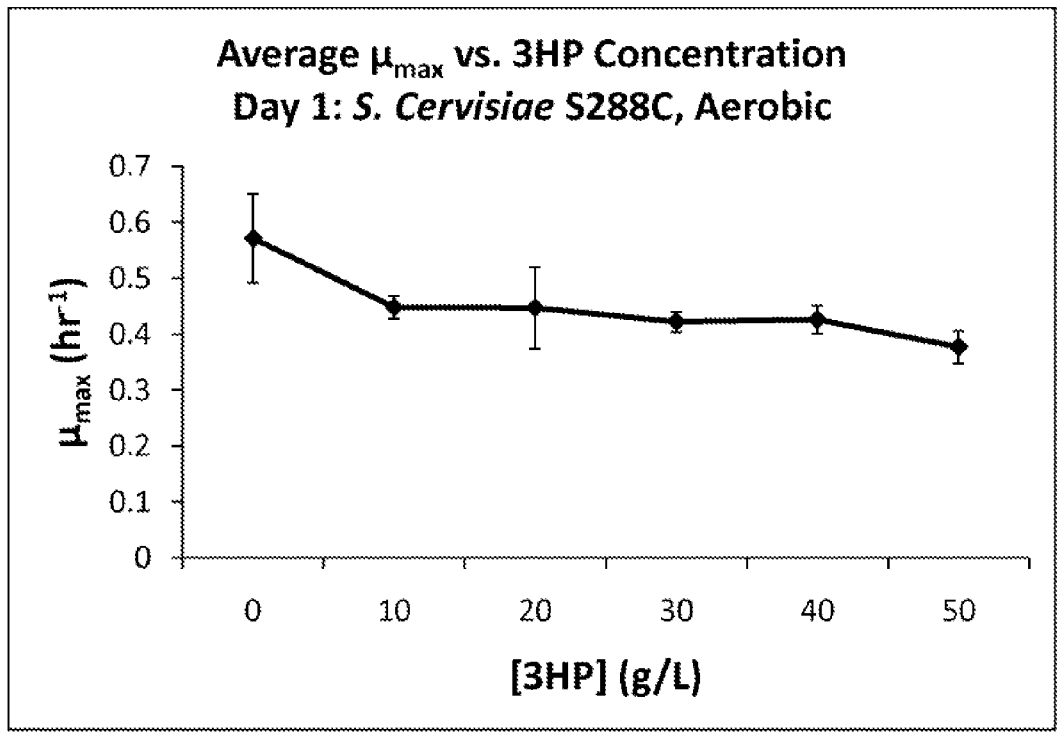
Figure 15K:
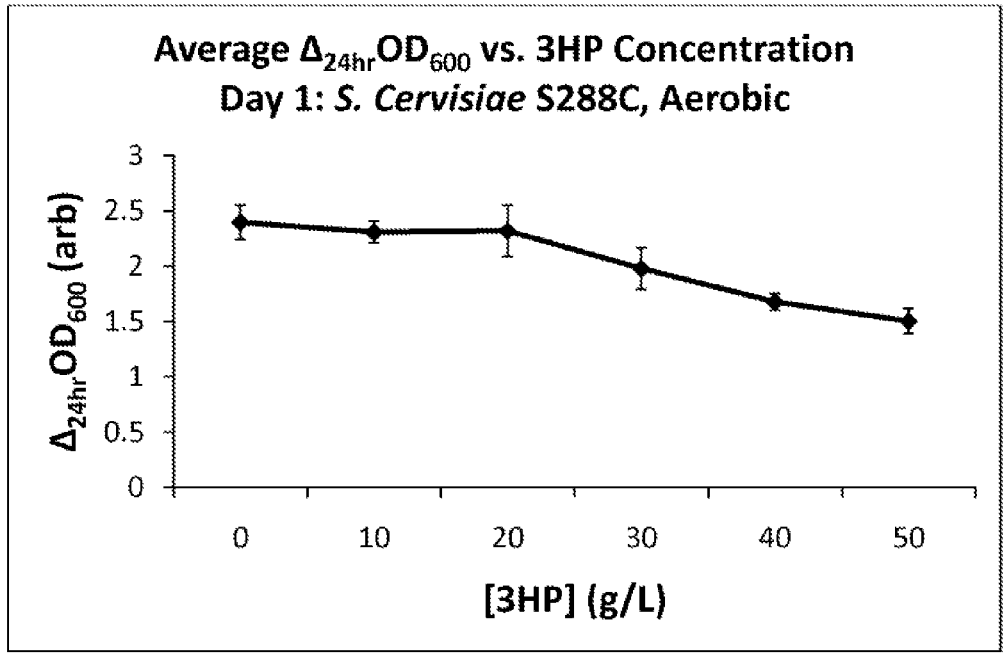
Figure 15L:
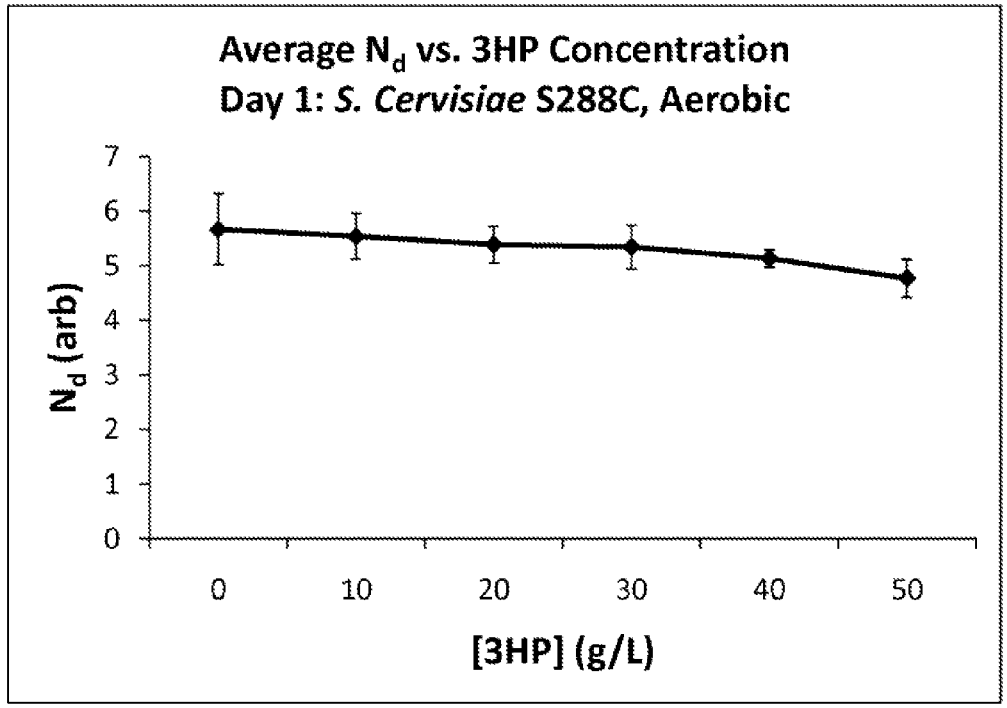
Figure 15M:
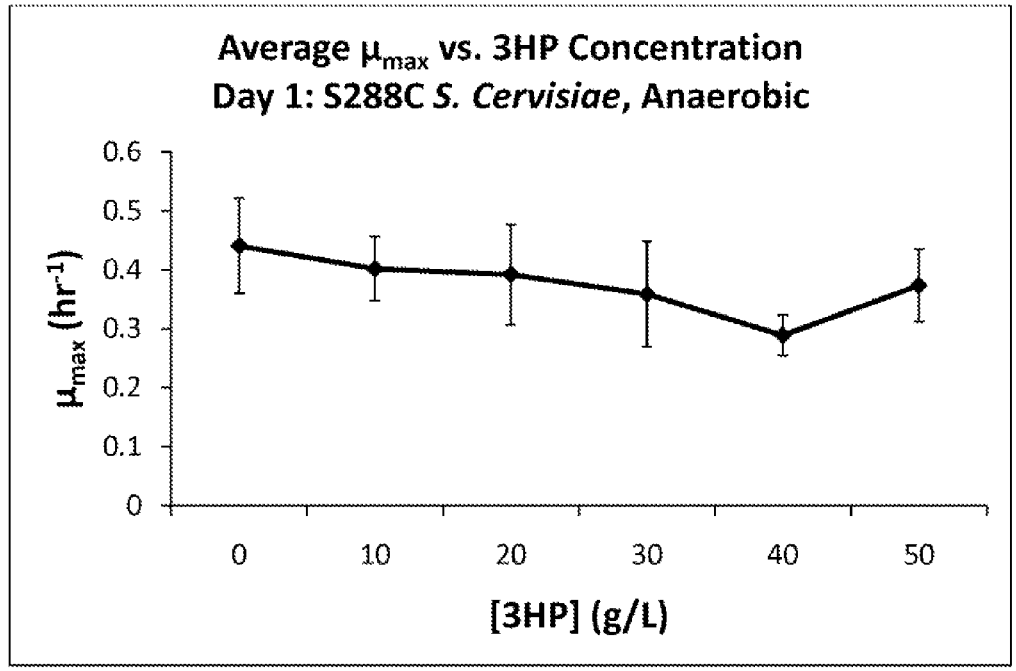
Figure 15N:
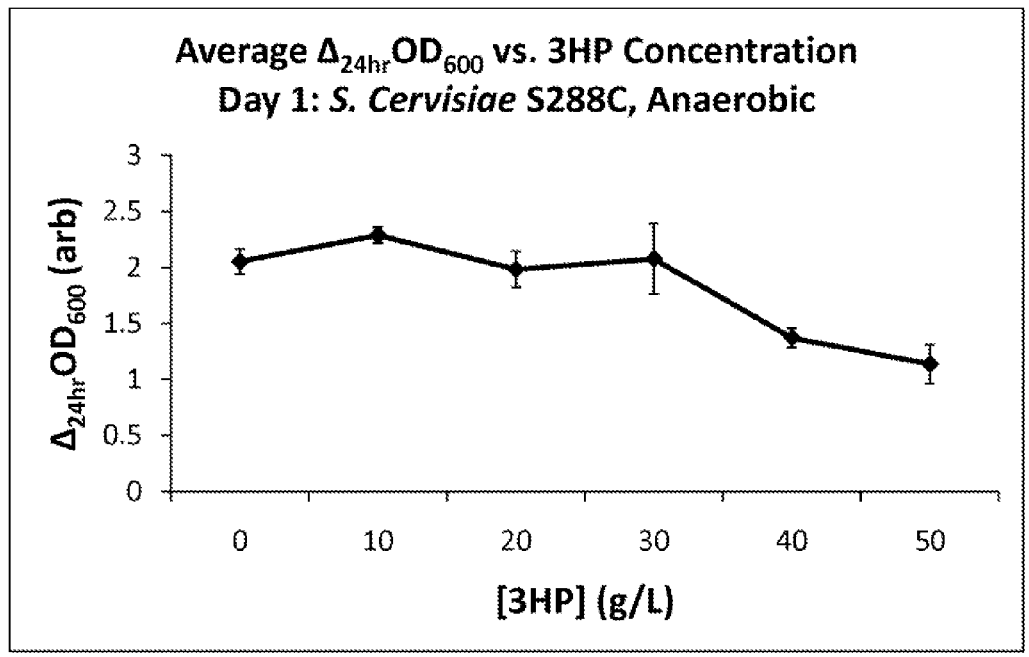
Figure 15O:
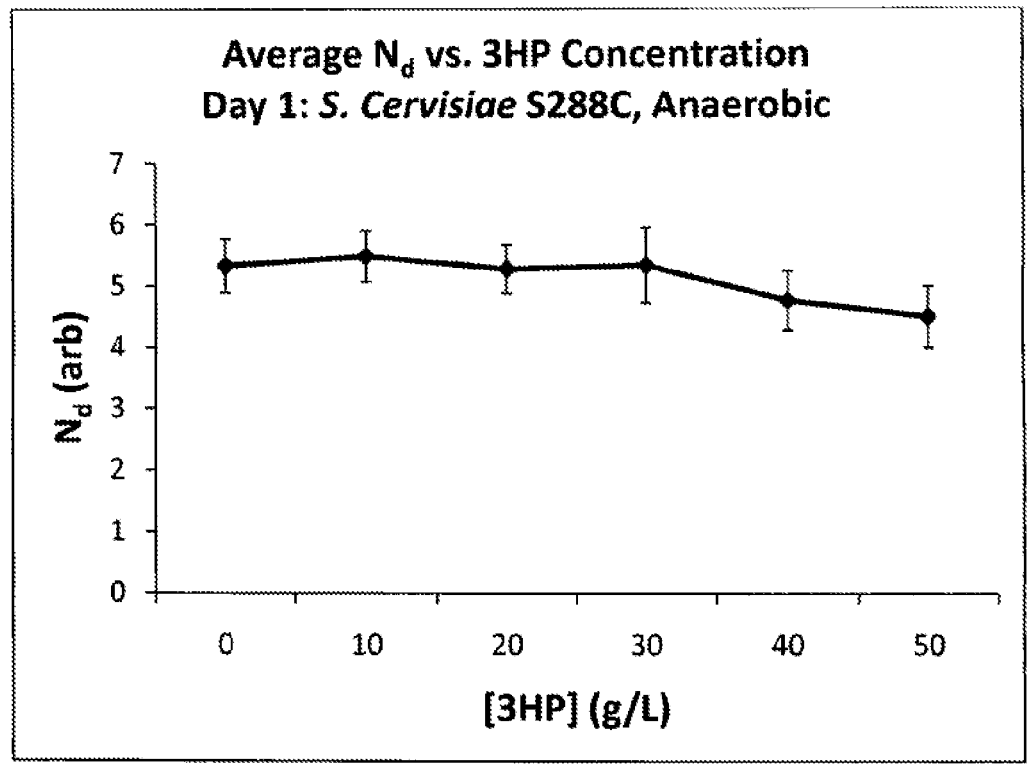

FIGS. 15A-O provide data from various control microorganism responses to different 3-HP concentrations. The data in these figures is shown variously as changes in maximum growth rate ($\mu_{max}$), changes in optical density ("OD"), and relative doubling times over a given period, here 24 hours.

Determination of growth rates, lag times and maximum growth rates are commonly used analyses to develop comparative metrics. FIGS. 15A, 15D, 15G, 15J, and 15M demonstrate changes in maximum growth rates over a 24-hour test period for the indicated species under the indicated aerobic or anaerobic test conditions. When representing this data for a range of concentrations of a chemical of interest that is believed toxic and/or inhibitory to growth, this representation is termed a "toleragram" herein. Here, growth toleragrams are generated by measuring the specific growth rates of microorganisms subjected to growth conditions including varying amounts of 3-HP.

Figure 15P:
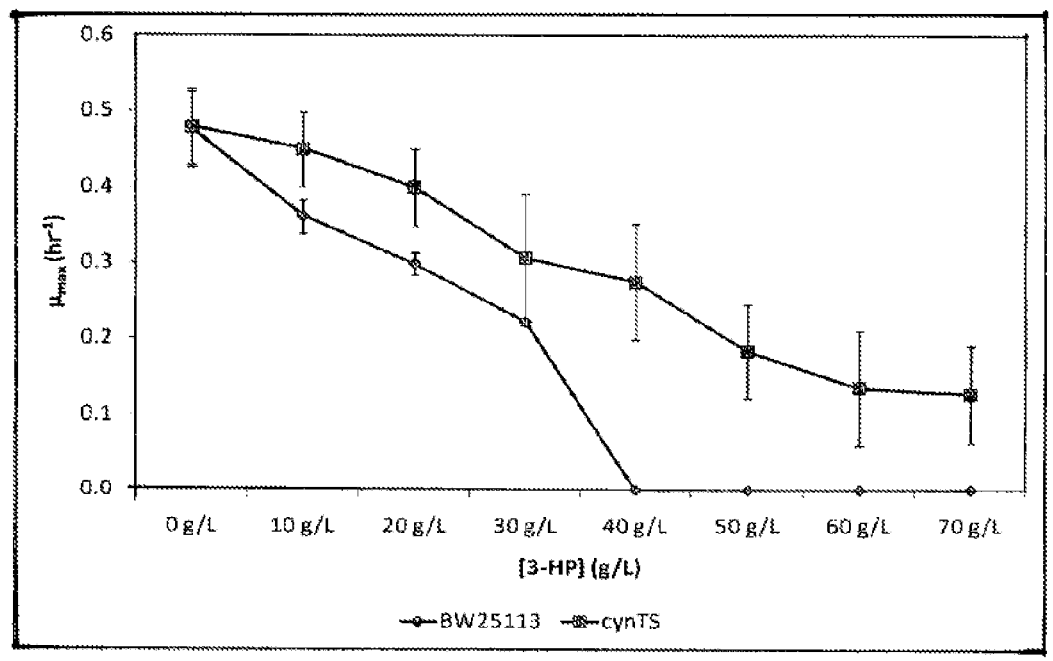

Further, FIG. 15P compares the growth toleragrams of a control microorganism culture with a microorganism in which genetic modification was made to increase expression of cynTS (in Group C of the 3HPTGC). The curve for a cynTS genetic modification in E. coli shows increasing maximum growth rate with increasing 3-HP concentration over a 24-hour evaluation period for each 3-HP concentration. This provides a qualitative visually observable difference. However, the greater area under the curve for the cynTS genetic modification affords a quantitative difference as well, which may be used for comparative purposes with other genetic modifications intended to improve 3-HP tolerance. Evaluation of such curves may lead to more effective identification of genetic modifications and/or supplements, and combinations thereof.

FIGS. 15B, 15E, 15H, 15K, and 15N demonstrate a control microorganism responses to different 3-HP concentrations wherein optical density ("OD," measured at 600 nanometers) at 24-hours is the metric used. OD600 is a conventional measure of cell density in a microorganism culture. For E. coli under aerobic condition, FIG. 15B demonstrates a dramatic reduction in cell density at 24 hours starting at 30 g/L 3-HP. FIG. 15D shows a relatively sharper and earlier drop for E. coli under anaerobic conditions.

FIGS. 15C, 15F, 15I, 15L, and 15O demonstrate control microorganism responses to different 3-HP concentrations wherein the number of cell doublings during the 24-hour period are displayed.

The above is intended as a non-limiting description of various ways to assess 3-HP tolerance improvements. Generally, demonstrable improvements in growth and/or survival are viewed as ways to assess an increase in tolerance, such as to 3-HP.

Embodiments of the present invention may result from introduction of an expression vector into a host microorganism, wherein the expression vector contains a nucleic acid sequence coding for an enzyme that is, or is not, normally found in a host microorganism. With reference to the host microorganism's genome prior to the introduction of the heterologous nucleic acid sequence, then, the nucleic acid sequence that codes for the enzyme is heterologous (whether or not the heterologous nucleic acid sequence is introduced into that genome).

Generally, it is within the scope of the invention to provide one or more genetic modifications to increase a recombinant microorganism's tolerance to 3-HP by any one or more of the approaches described herein. Thus, within the scope of any of the above-described alternatives and embodiments thereof are the composition results of respective methods, that is, genetically modified microorganisms that comprise the one or more, two or more, three or more, etc. genetic modifications referred to toward obtaining increased tolerance to 3-HP.

Also, it is within the scope of the invention to provide, in a suitable culture vessel comprising a selected microorganism, one or more supplements that are intermediates or end products (collectively, "products") of the 3HPTGC. Table 5 recites a non-limiting listing of supplements that may be added in a culture vessel comprising a genetically modified microorganism comprising one or more genetic modifications to the 3HPTGC and/or 3-HP production pathways. For example, not to be limiting, one or more of lysine, methionine, and bicarbonate may be provided. Such supplement additions may be combined with genetic modifications, as described herein, of the selected microorganism.

TABLE 5

| Supplement | Source | TGC Group | Concentration, g/L | Note |
|---|---|---|---|---|
| Tyrosine | Sigma, St. Louis, MO | A | 0.036 | dissolve in 0.01 KOH, pH final to 7 |
| Phenylalanine | Sigma, St. Louis, MO | A | 0.0664 | |
| Tryptophan | Sigma, St. Louis, MO | A | 0.0208 | |
| Shikimate | Sigma, St. Louis, MO | A | 0.1 | |
| p-aminobenzoate | MP Biomedicals, Aurora, OH | A | 0.069 | |
| Dihydroxybenzoate | Sigma, St. Louis, MO | A | 0.077 | |
| Tetrahydrofolate | Sigma, St. Louis, MO | A | 0.015 | 10% DMSO |
| Homocysteine | MP Biomedicals, Aurora, OH | B | 0.008 | |
| Isoleucine | Sigma, St. Louis, MO | B | 0.0052 | |
| Serine | Sigma, St. Louis, MO | B | 1.05 | |
| Glycine | Fisher Scientific, Fair Lawn, NJ | B | 0.06 | |

TABLE 5-continued

| Supplement | Source | TGC Group | Concentration, g/L | Note |
|---|---|---|---|---|
| Methionine | Sigma, St. Louis, MO | B | 0.03 | |
| Threonine | Sigma, St. Louis, MO | B | 0.0476 | |
| 2-oxobutyrate | Fluka Biochemika, Hungary | B | 0.051 | |
| Homoserine | Acros Organics, NJ | B | 0.008 | |
| Aspartate | Sigma, St. Louis, MO | B | 0.0684 | |
| Putrescine | MP Biomedicals, Salon, OH | C | 0.9 | |
| Cadaverine | MP Biomedicals, Salon, O | C | 0.6 | |
| Spermidine | MP Biomedicals, Salon, OH | C | 0.5 | |
| Ornithine | Sigma, St. Louis, MO | C | 0.2 | |
| Citrulline | Sigma, St. Louis, MO | C | 0.2 | |
| Bicarbonate | Fisher Scientific, Fair Lawn, NJ | C | 1 | |
| Glutamine | Sigma, St. Louis, MO | C | 0.09 | dissolve in 1 M HCl, pH final to 7 |
| Lysine | Sigma, St. Louis, MO | D | 0.0732 | |
| Uracil | Sigma, St. Louis, MO | E | 0.224 | |
| Citrate | Fisher Scientific, Fair Lawn, NJ | F | 2 | |
| Chorismate Group Mix (includes all Group A supplements listed above) | See above | A | See respective concentrations above | |
| Homocysteine Group Mix (includes all Group B supplements listed above) | See above | B | See respective concentrations above | |
| Polyamine Group Mix (includes all Group C supplements listed above) | See above | C | See respective concentrations above | |

Further as to supplements, as to Group C regarding polyamine synthesis, the results of the examples demonstrate that 3-HP tolerance of *E. coli* was increased by adding the polyamines putrescine, spermidine and cadaverine to the media. Minimum inhibitory concentrations (MICs) for *E. coli* K12 in control and supplemented media were as follows: in M9 minimal media supplemented with putrescine 40 g/L, in M9 minimal media supplemented with spermidine 40 g/L, in M9 minimal media supplemented with cadaverine 30 g/L. Minimum inhibitory concentrations (MICs) for added sodium bicarbonate in M9 minimal media was 30 g/L. The Minimum inhibitory concentrations (MICs) for *E. coli* K12 in 100 g/L stock solution 3-HP was 20 g/L.

Further, in view of the increase over the control MIC with sodium bicarbonate supplementation, other alteration, such as regulation and/or genetic modification of carbonic anhydrase, such as providing a heterologous nucleic acid sequence to a cell of interest, where that nucleic acid sequence encodes a polypeptide possessing carbonic anhydrase activity are considered of value to increase tolerance to 3-HP (such as in combination with other alterations of the 3HPTGC). Similarly, and as supported by other data provided herein, alterations of the enzymatic activities, such as by genetic modification(s) of enzyme(s) along the 3HPTGC pathway portions that lead to arginine, putrescine, cadaverine and spermidine, are considered of value to increase tolerance to 3-HP (such as in combination with other alterations of the 3HPTGC).

It is appreciated that the results of supplementations evaluations provide evidence of the utility of direct supplementation into a culture media, and also of improving 3-HP tolerance by a genetic modification route, such as is provided in some examples herein. It is appreciated that increasing the concentration of a product of a 3HPTGC enzymatic conversion step, such as by a genetic modification, whether by supplementation and/or genetic modification(s), may be effective to increase the intracellular concentration of one or more 3HPTGC products in a microorganism and/or in the media in which such microorganism is cultured.

Taken together, the fitness data and subsequently obtained data from the examples related to genetic modifications and/or supplements pertaining to the 3HPTGC support a concept of a functional relationship between such alterations to increase enzymatic conversion along the pathways of the 3HPTGC and the resulting functional increase in 3-HP tolerance in a microorganism cell or culture system. This is observable for the 3HPTGC as a whole and also within and among its defined groups.

Further, tables 47, 48, 50, 52, 53, and 56, incorporated into this section, provide non-limiting examples supplements additions, genetic modifications, and combinations of supplements additions and genetic modifications. Additional supplementations, genetic modifications, and combinations thereof, may be made in view of these examples and the described methods of identifying genetic modifications toward achieving an elevated tolerance to 3-HP in a microorganism of interest. Particular combinations may involve only the 3HPTGC lower section, including combinations involving two or more, three or more, or four or more, of the five groups therein (each involving supplement additions and/or genetic modification), any of these in various embodiments also comprising one or more genetic modifications or supplement additions regarding the 3HPTGC upper section. Subject matter in the Examples is incorporated into this section to the extent not already present.

Based on these results, it is appreciated that in various embodiments of the invention, whether methods or compositions, as a result of genetic modification and/or supplementation of reactants of the 3HPTGC, the alteration(s) directed to the 3HPTGC are effective to increase 3-HP tolerance by at least 5 percent, at least 10 percent, at least 20 percent, at least 30 percent, or at least 50 percent above a 3-HP tolerance of a control microorganism, lacking said at least one 3HPTGC genetic modification.

As is appreciated by the examples, any of the genetically modified microorganisms of the invention may be provided in a culture system and utilized, such as for the production of 3-HP. In some embodiments, one or more supplements (that are products of the 3HPTGC enzymatic conversion steps) are provided to a culture system to further increase overall 3-HP tolerance in such culture system.

Increased tolerance to 3-HP, whether of a microorganism or a culture system, may be assessed by any method or approach known to those skilled in the art, including but not limited to those described herein.

The genetic modification of the 3HPTGC upper portion may involve any of the enzymatic conversion steps. One, non-limiting example regards the tricarboxylic acid cycle. It is known that the presence and activity of the enzyme citrate synthase (E.C. 2.3.3.1 (previously 4.1.3.7)), which catalyzes the first step in that cycle, controls the rate of the overall cycle (i.e., is a rate-limiter). Accordingly, genetic modification of a microorganism, such as to increase copy numbers and/or specific activity, and/or other related characteristics (such as lower effect of a feedback inhibitor or other control molecule), may include a modification of citrase synthase. Ways to effectuate such change for citrate synthase may utilize any number of laboratory techniques, such as are known in the art, including approaches described herein for other enzymatic conversion steps of the 3HPTGC. Further, several commonly known techniques are described in U.S. Pat. Nos. 6,110,714 and 7,247,459, both assigned to Ajinomoto Co., Inc., both of which are herewith incorporated by reference for their respective teachings about amplifying citrate synthase activity (specifically, cols. 3 and 4, and Examples 3 and 4, of U.S. Pat. No. 6,110,714, and cols. 11 and 12 (specifically Examples (1) and (2)) of U.S. Pat. No. 7,247,459).

In various embodiments E. coli strains are provided that comprise selected gene deletions directed to increase enzymatic conversion in the 3HPTGC and accordingly increase microorganism tolerance to 3-HP. For example, the following genes, which are associated with repression of pathways in the indicated 3HPTGC Groups, may be deleted: Group A—tyrR, trpR; Group B—metJ; Group C—purR; Group D—lysR; Group E—nrdR. There are for E. coli and it is known and determinable by one skilled in the art to identify and genetically modify equivalent repressor genes in this and other species.

A disruption of gene function may also be effectuated, in which the normal encoding of a functional enzyme by a nucleic acid sequence has been altered so that the production of the functional enzyme in a microorganism cell has been reduced or eliminated. A disruption may broadly include a gene deletion, and also includes, but is not limited to gene modification (e.g., introduction of stop codons, frame shift mutations, introduction or removal of portions of the gene, introduction of a degradation signal), affecting mRNA transcription levels and/or stability, and altering the promoter or repressor upstream of the gene encoding the polypeptide. In some embodiments, a gene disruption is taken to mean any genetic modification to the DNA, mRNA encoded from the DNA, and the amino acid sequence that results in at least a 50 percent reduction of enzyme function of the encoded gene in the microorganism cell.

Further, as to the full scope of the invention and for various embodiments, it is recognized that the above discussion and the examples are meant to be exemplary and not limiting. Genetic manipulations may be made to achieve a desired alteration in overall enzyme function, such as by reduction of feedback inhibition and other facets of control, including alterations in DNA transcriptional and RNA translational control mechanisms, improved mRNA stability, as well as use of plasmids having an effective copy number and promoters to achieve an effective level of improvement. Such genetic modifications may be chosen and/or selected for to achieve a higher flux rate through certain basic pathways within the 3HPTGC and so may affect general cellular metabolism in fundamental and/or major ways. Accordingly, in certain alternatives genetic modifications are made more selectively, to other parts of the 3HPTGC.

Further, based on analysis of location and properties of committed steps, feedback inhibition, and other factors and constraints, in various embodiments at least one genetic modification is made to increase overall enzymatic conversion for one of the following enzymes of the 3HPTGC: 2-dehydro-3-deoxyphosphoheptonate aldolase (e.g., aroF, aroG, aroH); cyanase (e.g., cynS); carbonic anhydrase (e.g., cynT); cysteine synthase B (e.g., cysM); threonine deaminase (e.g., ilvA); ornithine decarboxylase (e.g., speC, speF); adenosyl-methionine decarboxylase (e.g., speD); and spermidine synthase (e.g., speE). Genetic modifications may include increasing copy numbers of the nucleic acid sequences encoding these enzymes, and providing modified nucleic acid sequences that have reduced or eliminated feedback inhibition, control by regulators, increased affinity for substrate, and other modifications. Thus, one aspect of the invention is to genetically modify one or more of these enzymes in a manner to increase enzymatic conversion at one or more 3HPTGC enzymatic conversion steps so as to increase flux and/or otherwise modify reaction flows through the 3HPTGC so that 3-HP tolerance is increased. In addition to the examples which pertain to genetic modifications regarding aroH and cyanase (with carbonic anhydrase), respectively, the following examples are provided. It is noted that in E. coli a second carbonic anhydrase enzyme is known. This is identified variously as Can and yadf.

Also, it is appreciated that various embodiments of the invention may comprise genetic modifications of the 3HPTGC (as may be provided in a microorganism, as described herein), and/or supplements thereof, excluding any one or more designated enzymatic conversion steps, product additions, and/or specific enzymes. For example, an embodiment of the invention may comprise genetic modifications of the 3HPTGC in a microorganism, however excluding those of Group A, or of Groups A and B, or of a defined one or more members of the 3HPTGC (which may be any subset of the 3HPTGC members).

For example, without being limiting, a modified 3HPTGC may comprise all members of the 3HPTGC as depicted herein except the degradative form of arginine decarboxylase (adiA, which is known to be induced in rich medium at low pH under anaerobic conditions in the presence of excess substrate), or other subsets excluding such degradative arginine decarboxylase and other selected enzyme steps. Other modified 3HPTGC complexes may also be practiced in various embodiments. Based on the noted induction of adiA, the use of the degradative form of arginine decarboxylase is not be considered within the scope of the 3HPTGC for 3-HP tolerance improvement as practiced under aerobic conditions.

Moreover, various non-limiting aspects of the invention may include, but are not limited to:

A genetically modified (recombinant) microorganism comprising a nucleic acid sequence that encodes a polypeptide with at least 85% amino acid sequence identity to any of the enzymes of any of 3-HP tolerance-related or biosynthetic pathways, wherein the polypeptide has enzymatic activity and specificity effective to perform the enzymatic reaction of the respective 3-HP tolerance-related or biosynthetic pathway enzyme, and the recombinant microorganism exhibits greater 3-HP tolerance and/or 3-HP bio-production than an appropriate control microorganism lacking such nucleic acid sequence.

A genetically modified (recombinant) microorganism comprising a nucleic acid sequence that encodes a polypeptide with at least 90% amino acid sequence identity to any of the enzymes of any of 3-HP tolerance-related or biosynthetic pathways, wherein the polypeptide has enzymatic activity and specificity effective to perform the enzymatic reaction of the respective 3-HP tolerance-related or biosynthetic pathway enzyme, and the recombinant microorganism exhibits greater 3-HP tolerance and/or 3-HP bio-production than an appropriate control microorganism lacking such nucleic acid sequence.

A genetically modified (recombinant) microorganism comprising a nucleic acid sequence that encodes a polypeptide with at least 95% amino acid sequence identity to any of the enzymes of any of 3-HP tolerance-related or biosynthetic pathways, wherein the polypeptide has enzymatic activity and specificity effective to perform the enzymatic reaction of the respective 3-HP tolerance-related or biosynthetic pathway enzyme, and the recombinant microorganism exhibits greater 3-HP tolerance and/or 3-HP bio-production than an appropriate control microorganism lacking such nucleic acid sequence. In some embodiments, the at least one polypeptide has at least 99% or 100% sequence identity to at least one of the enzymes of a 3-HPTGC pathway and/or a 3-HP biosynthetic pathway.

In one aspect of the invention the identity values in the preceding paragraphs are determined using the parameter set described above for the FASTDB software program, or BLASTP or BLASTN, such as version 2.2.2, using default parameters. Further, for all specifically recited sequences herein it is understood that conservatively modified variants thereof are intended to be included within the invention. In accordance with the present disclosure, in various embodiments the invention contemplates a genetically modified (e.g., recombinant) microorganism comprising a heterologous nucleic acid sequence that encodes a polypeptide that is an identified enzymatic functional variant of any of the enzymes of any of 3-HP tolerance-related pathways, or pathway portions (i.e., of the 3HPTGC), or other enzyme disclosed herein (e.g., of a 3-HP production pathway), wherein the polypeptide has enzymatic activity and specificity effective to perform the enzymatic reaction of the respective 3-HP tolerance-related or other enzyme, so that the recombinant microorganism exhibits greater 3-HP tolerance or other function than an appropriate control microorganism lacking such nucleic acid sequence. Relevant methods of the invention also are intended to be directed to identified enzymatic functional variants and the nucleic acid sequences that encode them. Embodiments may also comprise other functional variants.

In some embodiments, the invention contemplates a recombinant microorganism comprising at least one genetic modification effective to increase 3-hydroxypropionic acid ("3-HP") production, wherein the increased level of 3-HP production is greater than the level of 3-HP production in the wild-type microorganism, and at least one genetic modification of the 3-HP Toleragenic Complex ("3HPTGC"). In some embodiments, the wild-type microorganism produces 3-HP. In some embodiments, the wild-type microorganism does not produce 3-HP. In some embodiments, the recombinant microorganism comprises at least one vector, such as at least one plasmid, wherein the at least one vector comprises at least one heterologous nucleic acid molecule.

In some embodiments of the invention, the at least one genetic modification of the 3HPTGC is effective to increase the 3-HP tolerance of the recombinant microorganism above the 3-HP tolerance of a control microorganism, wherein the control microorganism lacks the at least one 3HPTGC genetic modification. In some embodiments, the 3-HP tolerance of the recombinant microorganism is increased above the 3-HP tolerance of a control microorganism by about 5%, 10%, or 20%. In some embodiments, the 3-HP tolerance of the recombinant microorganism is increased above the 3-HP tolerance of a control microorganism by about 30%, 40%, 50%, 60%, 80%, or 100%.

Also, in various embodiments, the at least one genetic modification of the 3HPTGC encodes at least one polypeptide exhibiting at least one enzymatic conversion of at least one enzyme of the 3HPTGC, wherein the recombinant microorganism exhibits an increased 3-HP tolerance at least about 5, 10, 20, 30, 40, 50, 60, or 100 percent greater, or more, than the 3-HP tolerance of a control microorganism lacking the at least one genetic modification of the 3HPTGC, Any evaluations for such tolerance improvements may be based on a Minimum Inhibitory Concentration evaluation in a minimal media.

In some embodiments, the microorganism further comprises at least one additional genetic modification encoding at least one polypeptide exhibiting at least one enzymatic conversion of at least one enzyme of a second Group different from the genetic modification of a first Group of the 3HPTGC, wherein the recombinant microorganism exhibits an increased 3-HP tolerance at least about 5, 10, 20, 30, 40, 50, 60, or 100 percent greater, or more, than the 3-HP tolerance of a control microorganism lacking all said genetic modifications of the 3HPTGC. In the various embodiments, the at least one additional genetic modification further comprises a genetic modification from each of two or more, or three or more, of the Groups A-F.

For example, the genetic modifications may comprise at least one genetic modification of Group A and at least one genetic modification of Group B, at least one genetic modification of Group A and at least one genetic modification of Group C, at least one genetic modification of Group A and at least one genetic modification of Group D, at least one genetic modification of Group A and at least one genetic modification of Group E, at least one genetic modification of Group B and at least one genetic modification of Group C, at least one genetic modification of Group B and at least one genetic modification of Group D, at least one genetic modification of Group B and at least one genetic modification of Group E, at least one genetic modification of Group C and at least one genetic modification of Group D, at least one genetic modification of Group C and at least one genetic modification of Group E, or at least one genetic modification of Group D and at least one genetic modification of Group E. Any such combinations may be further practiced with Group F genetic modifications.

In some embodiments, the recombinant microorganism comprises one or more gene disruptions of 3HPTGC repressor genes selected from tyrR, trpR, metJ, argR, purR, lysR and nrdR.

In some embodiments, the at least one genetic modification of the 3HPTGC comprises means to increase expression of SEQ ID NO: 129 (Irok peptide). In some embodiments, the recombinant microorganism is an *E. coli* strain. In some embodiments, the recombinant microorganism is a *Cupriavidus necator* strain.

In some embodiments, the at least one genetic modification encodes at least one polypeptide with at least 85% amino acid sequence identity to at least one of the enzymes of a 3-HPTGC pathway, a 3-HP biosynthetic pathway, and/or SEQ ID NO: 129 (Irok).

Some embodiments of the invention contemplate a culture system. In some embodiments, the culture system comprises a genetically modified microorganism as described herein and a culture media. Such genetically modified microorganism may comprise a single genetic modification of the 3HPTGC, or any of the combinations described herein, and may additionally comprise one or more genetic modifications of a 3-HP production pathway. In some embodiments, the culture media comprises at least about 1 g/L, at least about 5 g/L, at least about 10 g/L, at least about 15 g/L, or at least about 20 g/L of 3-HP. In some embodiments, the culture system comprises a 3HPTGC supplement at a respective concentration such as that shown herein.

In some embodiments the invention contemplates a method of making a genetically modified microorganism comprising providing at least one genetic modification to increase the enzymatic conversion of the genetically modified microorganism over the enzymatic conversion of a control microorganism, wherein the control microorganism lacks the at least one genetic modification, at an enzymatic conversion step of the 3-hydroxypropionic acid Toleragenic Complex ("3HPTGC"), wherein the genetically modified microorganism synthesizes 3-HP. In some embodiments, the control microorganism synthesizes 3-HP. In some embodiments, the at least one genetic modification increases the 3-HP tolerance of the genetically modified microorganism above the 3-HP tolerance of the control microorganism.

In some embodiments, the 3-HP tolerance of the genetically modified microorganism is at least about 5 percent, at least about 10 percent, at least about 20 percent, at least about 30 percent, at least about 40 percent, at least about 50 percent, or at least about 100 percent above the 3-HP tolerance of the control microorganism. In some embodiments, the 3-HP tolerance of the genetically modified microorganism is from about 50 to about 300 percent above the 3-HP tolerance of the control microorganism, based on a Minimum Inhibitory Concentration evaluation in a minimal media. In some embodiments, the genetically modified microorganism further comprises one or more gene disruptions of 3HPTGC repressor genes selected from tyrR, trpR, metJ, argR, purR, lysR and nrdR. In some embodiments, the control microorganism does not synthesize 3-HP. In some embodiments, providing at least one genetic modification comprises providing at least one vector. In some embodiments, the at least one vector comprises at least one plasmid. In some embodiments, providing at least one genetic modification comprises providing at least one nucleic acid molecule. In some embodiments, the at least one nucleic acid molecule is heterologous. In some embodiments, the at least one nucleic acid molecule encodes SEQ ID NO: 129 (Irok).

In some embodiments, genetic modifications are made to increase enzymatic conversion at an enzymatic conversion step identified to have an elevated fitness score in Table 3 and/or evaluated in the Examples. Enzymes that catalyze such reactions are numerous and include cyanase and carbonic anhydrase.

Also, it is appreciated that various embodiments of the invention may be directed to amino acid sequences of enzymes that catalyze the enzymatic conversion steps of the 3HPTGC for any species. More particularly, the amino acid sequences of the 3HPTGC for FIGS. 9A-D are readily obtainable from one or more of commonly used bioinformatics databases (e.g., <<www.ncbi.gov>>; <<www.metacyc.org>>) by entering a respective gene for an enzymatic conversion step therein.

IX. Combinations of Genetic Modifications

As described in U.S. Provisional Patent Application No. 61/246,141, incorporated by reference and to which priority is claimed, various combinations of genetic modifications may be implemented in various embodiments of the invention. These are described in the following paragraphs and Tables 6A, 6B and 7, noting that the first paragraphs related to various forms of malonlyl-CoA reductace that may be used in the combinations.

Various embodiments of the present invention comprise a genetically modified microorganism comprising at least one genetic modification to introduce or increase malonyl-CoA-reductase enzymatic activity, including by introducing a polynucleotide that expresses a functional equivalent of the malonyl-CoA-reductase provided herein. A functional equivalent of malonyl-CoA-reductase enzymatic activity is capable of increasing enzymatic activity for conversion of malonyl-CoA to malonate semialdehyde, malonate semialdehyde to 3-HP, or both.

In some embodiments, the amino acid sequence of the malonyl-CoA-reductase comprises SEQ ID NO:783. In other embodiments, the malonyl-CoA-reductase comprises a variant of any of SEQ ID NOs:783 to 791 exhibiting malonyl-CoA-reductase enzymatic activity.

The amino acid sequence of the malonyl-CoA-reductase can comprise an amino acid sequence having at least 50%, 60%, 70%, 80%, 85%, 90%, 92%, 95%, 96%, 97%, 98% or 99% sequence identity to any one of SEQ ID NOs: 783 to 791.

In some embodiments, at least one genetic modification comprises providing a polynucleotide that encodes an amino acid sequence comprising one of, or a functional portion of, any of SEQ ID NOs: 783 to 791. In various embodiments, at least one genetic modification comprises providing a polynucleotide that encodes an amino acid sequence having at least 50%, 60%, 70%, 80%, 85%, 90%, 92%, 95%, 96%, 97%, 98% or 99% sequence identity to any of SEQ ID NOs: 783 to 791.

In exemplary embodiments, the polynucleotide is codon-optimized for a selected microorganism species to encode any one of SEQ ID NOs: 783 to 791. In various embodiments, the polynucleotide is codon-optimized to encode an amino acid sequence having at least 50%, 60%, 70%, 80%, 85%, 90%, 92%, 95%, 96%, 97%, 98% or 99% sequence identity to any one of SEQ ID NOs: 783 to 791. The polynucleotide can be codon-optimized for *E. coli*, for example.

In some embodiments, the genetically modified microorganism that so possesses malonyl-CoA-reductase genetic modification(s) additionally comprises at least one genetic modification to increase, in the genetically modified microorganism, a protein function selected from the protein functions of Table 6A (Glucose transporter function (such as by galP), pyruvate dehydrogenase E1p, dihydrolipoamide acetyltransferase, and pyruvate dehydrogenase E3). In certain embodiments, the genetically modified microorganism comprises at least one genetic modification to increase two, three, or four protein functions selected from the protein functions of Table 6A.

In some embodiments, such genetically modified microorganism additionally comprises at least one genetic modification to decrease protein functions selected from the protein functions of Table 6B, lactate dehydrogenase, pyruvate formate lyase, pyruvate oxidase, phosphate acetyltransferase, histidyl phosphorylatable protein (of PTS), phosphoryl transfer protein (of PTS), and the polypeptide chain (of PTS).

In various embodiments, such genetically modified microorganism comprises at least one genetic modification to decrease enzymatic activity of two, three, four, five, six, or seven protein functions selected from the protein functions of Table 6B. Also, in various embodiments at least one, or more than one, genetic modification is made to modify the protein functions of Table 7 in accordance with the Comments therein.

It will be appreciated that, in various embodiments, there can be many possible combinations of increases in one or more protein functions of Table 6A, with reductions in one or more protein functions of Table 6A in the genetically modified microorganism comprising at least one genetic modification to provide or increase malonyl-CoA-reductase protein function (i.e, enzymatic activity). Protein functions can be independently varied, and any combination (i.e., a full factorial) of genetic modifications of protein functions in Tables 6A, 6B, and 7 herein can be adjusted by the methods taught and provided into said genetically modified microorganism.

In some embodiments, at least one genetic modification to decrease enzymatic activity is a gene disruption. In some embodiments, at least one genetic modification to decrease enzymatic activity is a gene deletion.

In various embodiments, to obtain 3-hydroxypropionic acid (3-HP) as a desired product, the genetically modified microorganism comprises a protein function effective for converting malonate semialdehyde to 3-HP. The protein function effective for converting malonate semialdehyde to 3-HP can be native to the microorganism, but that is by no means necessary.

In some embodiments, the protein function effective for converting malonate semialdehyde to 3-HP is a native or mutated form of mmsB from *Pseudomonas aeruginosas*, or a functional equivalent thereof. Alternatively, or additionally, this protein function can be a native or mutated form of ydfG, or a functional equivalent thereof.

Certain embodiments of the invention additionally comprise a genetic modification to increase the availability of the cofactor NADPH, which can increase the NADPH/NADP+ ratio as may be desired. Non-limiting examples for such genetic modification are pgi (E.C. 5.3.1.9, in a mutated form), pntAB (E.C. 1.6.1.2), overexpressed, gapA(E.C. 1.2.1.12): gapN (E.C. 1.2.1.9, from *Streptococcus mutans*) substitution/replacement, and disrupting or modifying a soluble transhydrogenase such as sthA (E.C. 1.6.1.2), and/or genetic modifications of one or more of zwf (E.C. 1.1.1.49), gnd (E.C. 1.1.1.44), and edd (E.C. 4.2.1.12). Sequences of these genes are available at www.metacyc.org. Also, the sequences for the genes and encoded proteins for the *E. coli* gene names shown in Tables 6A, 6B, and 7 are provided in U.S. Provisional Patent Application No. 61/246,141, incorporated herein in its entirety and for such sequences, and also are available at www.ncbi.gov as well as www.metacyc.org or www.ecocyc.org.

In some embodiments, the genetic modification increases microbial synthesis of 3-HP above a rate or titer of a control microorganism lacking said at least one genetic modification to produce 3-HP. In some embodiments, the genetic modification is effective to increase enzymatic conversions to 3-HP by at least about 5 percent, at least about 10 percent, at least about 20 percent, at least about 30 percent, or at least about 50 percent above the enzymatic conversion of a control microorganism lacking the genetic modification.

TABLE 6A

| Enzyme Function | E.C. Classification | Gene Name in *E. coli* |
|---|---|---|
| Glucose transporter | N/A | galP |
| Pyruvate dehydrogenase E1p | 1.2.4.1 | aceE |
| lipoate acetyltransferase/ dihydrolipoamide acetyltransferase | 2.3.1.12 | aceF |
| Pyruvate dehydrogenase E3 (lipoamide dehydrogenase) | 1.8.1.4 | lpd |

TABLE 6B

| Enzyme Function | E.C. Classification | Gene Name in *E. coli* |
|---|---|---|
| Lactate dehydrogenase | 1.1.1.28 | ldhA |
| Pyruvate formate lyase (B "inactive") | 2.3.1.- | pflB |
| Pyruvate oxidase | 1.2.2.2 | poxB |
| Phosphate acetyltransferase | 2.3.1.8 | Pta |
| Heat stable, histidyl phosphorylatable protein (of PTS) | N/A | ptsH (HPr) |
| Phosphoryl transfer protein (of PTS) | N/A | ptsI |
| Polypeptide chain (of PTS) | N/A | Crr |

TABLE 7

| Enzyme Function | E.C. Classification | Gene Name in *E. coli* | Comments |
|---|---|---|---|
| β ketoacyl-acyl carrier protein synthase II 3-OXOACYL-ACP-SYNTHASE II-MONOMER | 2.3.1.179 2.3.1.41 | fabF | Decrease function, including by mutation |
| β-ketoacyl-ACP synthase I, 3-oxoacyl-ACP-synthase I | 2.3.1.41 2.3.1.- | fabB | Decrease function, including by mutation |
| Malonyl-CoA-ACP transacylase | 2.3.1.39 | fabD | Decrease function, including by mutation |
| enoyl acyl carrier protein reductase | 1.3.1.9, 1.3.1.10 | fabI | Decrease function, including by mutation |
| β-ketoacyl-acyl carrier protein synthase III | 2.3.1.180 | fabH | Decrease function, including by mutation |
| Carboxyl transferase subunit α subunit | 6.4.1.2 | accA | Increase function |
| Biotin carboxyl carrier protein | 6.4.1.2 | accB | Increase function |
| Biotin carboxylase subunit | 6.3.4.14 | accC | Increase function |
| Carboxyl transferase subunit β subunit | 6.4.1.2 | accD | Increase function |

TABLE 7-continued

| Enzyme Function | E.C. Classification | Gene Name in E. coli | Comments |
|---|---|---|---|
| long chain fatty acyl thioesterase I | 3.1.2.2, 3.1.1.5 | tesA | Increase function |
| GDP pyrophosphokinase/GTP pyrophosphokinase | 2.7.6.5 | relA | Decrease function, including by mutation |
| GDP diphosphokinase/guanosine-3',5'-bis(diphosphate) 3'-diphosphatase | 2.7.6.5, 3.1.7.2 | spot | Decrease function, including by mutation |

Further with regard to decreasing enzyme function based on Table 7's teachings, any one or a combination of enzyme functions of the following may be decreased in a particular embodiment combined with other genetic modifications described herein: β-ketoacyl-ACP synthase 1,3-oxoacyl-ACP-synthase I; Malonyl-CoA-ACP transacylase; enoyl acyl carrier protein reductase; and β-ketoacyl-acyl carrier protein synthase III.

Accordingly, as described in various sections above, some compositions, methods and systems of the present invention comprise providing a genetically modified microorganism that comprises both a production pathway to a selected chemical product, such as 3-HP, and a modified polynucleotide that encodes an enzyme of the fatty acid synthase system that exhibits reduced activity, so that utilization of malonyl-CoA shifts toward the production pathway compared with a comparable (control) microorganism lacking such modifications. The methods involve producing the chemical product using a population of such genetically modified microorganism in a vessel, provided with a nutrient media. Other genetic modifications described herein, to other enzymes, such as acetyl-CoA carboxylase and/or NADPH-dependent transhydrogenase, may be present in some such embodiments. Providing additional copies of polynucleotides that encode polypeptides exhibiting these enzymatic activities is shown to increase 3-HP production. Other ways to increase these respective enzymatic activities is known in the art and may be applied to various embodiments of the present invention. SEQ ID NOs for these polynucleotides and polypeptides of E. coli are: acetyl-CoA carboxylase (accABCD, SEQ ID NOs:771-778); and NADPH-dependent transhydrogenase (SEQ ID NOs:779-782), also referred to as pyridine nucleotide transhydrogenase, pntAB in E. coli).

Also, without being limiting, a first step in some multi-phase method embodiments of making a chemical product may be exemplified by providing into a vessel, such as a culture or bioreactor vessel, a nutrient media, such as a minimal media as known to those skilled in the art, and an inoculum of a genetically modified microorganism so as to provide a population of such microorganism, such as a bacterium, and more particularly a member of the family Enterobacteriaceae, such as E. coli, where the genetically modified microorganism comprises a metabolic pathway that converts malonyl-CoA to 3-HP molecules. For example, genetic modifications may include the provision of at least one nucleic acid sequence that encodes a gene encoding the enzyme malonyl-CoA reductase in one of its bi-functional forms, or that encodes genes encoding a mono-functional malonyl-CoA reductase and an NADH- or NADPH-dependent 3-hydroxypropionate dehydrogenase (e.g., ydfG or mmsB from E. coli, or mmsB from Pseudomonas aeruginosa). In either case, when provided into an E. coli host cell, these genetic modifications complete a metabolic pathway that converts malonyl-CoA to 3-HP. This inoculum is cultured in the vessel so that the cell density increases to a cell density suitable for reaching a production level of 3-HP that meets overall productivity metrics taking into consideration the next step of the method. In various alternative embodiments, a population of these genetically modified microorganisms may be cultured to a first cell density in a first, preparatory vessel, and then transferred to the noted vessel so as to provide the selected cell density. Numerous multi-vessel culturing strategies are known to those skilled in the art. Any such embodiments provide the selected cell density according to the first noted step of the method.

Also without being limiting, a subsequent step may be exemplified by two approaches, which also may be practiced in combination in various embodiments. A first approach provides a genetic modification to the genetically modified microorganism such that its enoyl-ACP reductase enzymatic activity may be controlled. As one example, a genetic modification may be made to substitute for the native enoyl-ACP reductase a temperature-sensitive mutant enoyl-ACP reductase (e.g., fabI$^{TS}$ in E. coli). The latter may exhibit reduced enzymatic activity at temperatures above 30 C but normal enzymatic activity at 30 C, so that elevating the culture temperature to, for example to 34 C, 35 C, 36 C, 37 C or even 42 C, reduces enzymatic activity of enoyl-ACP reductase. In such case, more malonyl-CoA is converted to 3-HP or another chemical product than at 30 C, where conversion of malonyl-CoA to fatty acids is not impeded by a less effective enoyl-ACP reductase.

Figure 2A:
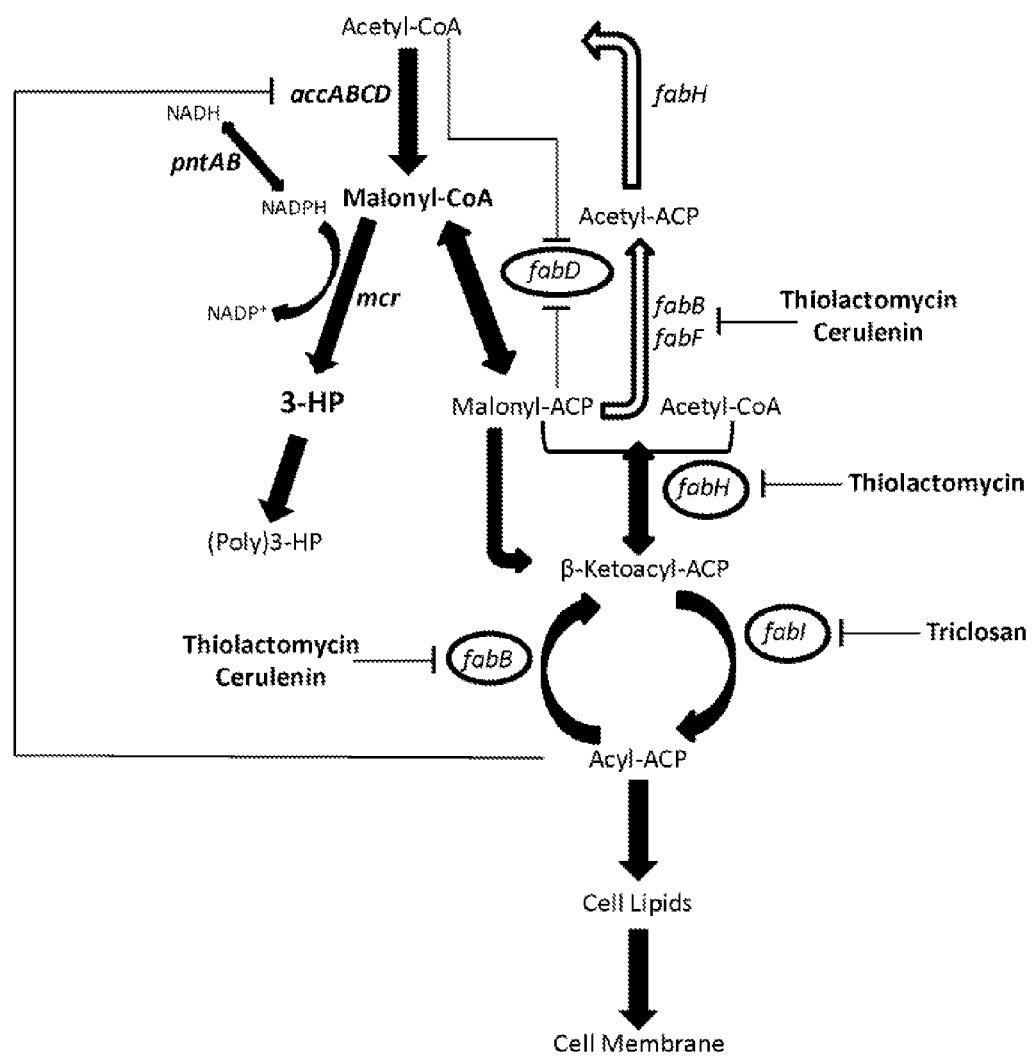
FIG. 2A depicts metabolic pathways of a microorganism related to aspects of the present invention, with gene names of *E. coli* shown at certain enzymatic steps, the latter for example and not meant to be limiting.
Figure 2B:
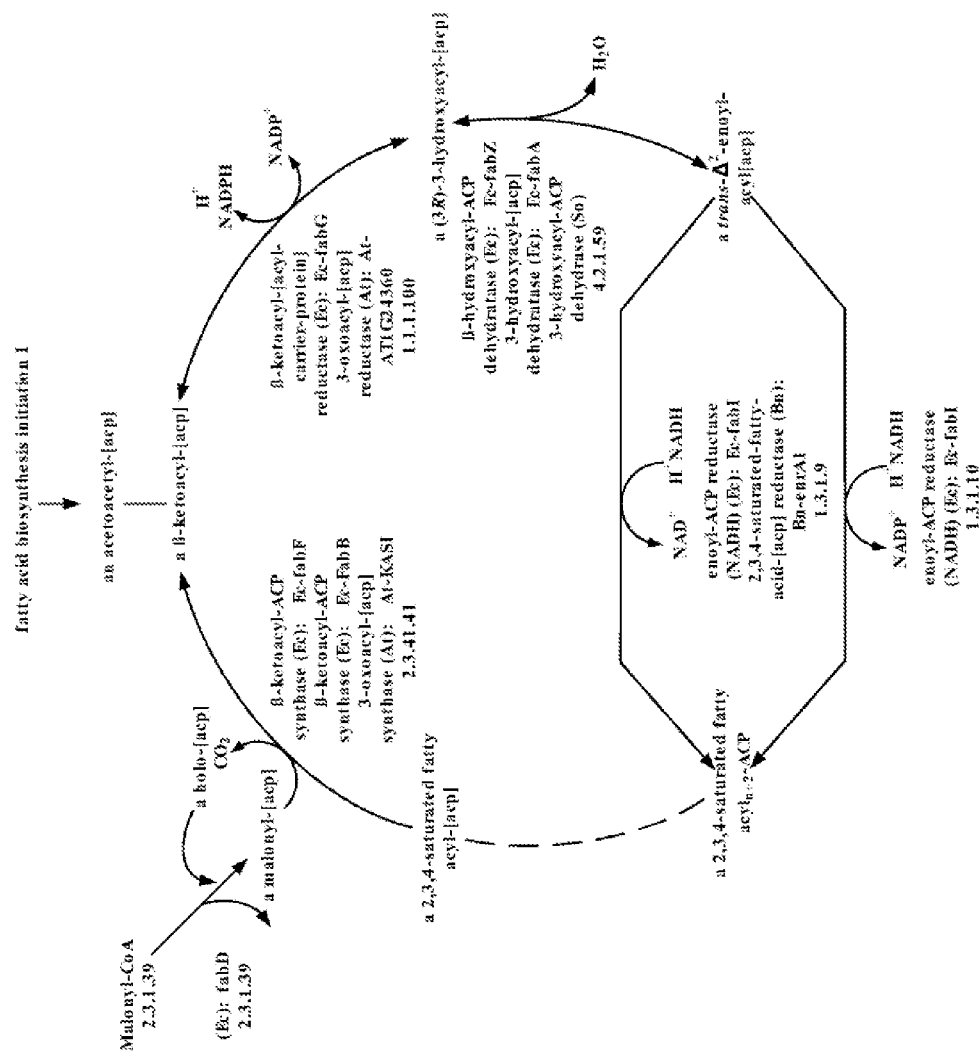
FIG. 2B provides a more detailed depiction of representative enzymatic conversions and exemplary *E. coli* genes of the fatty acid synthetase system that was more generally depicted in FIG. 2A.

For the second approach, an inhibitor of enoyl-ACP reductase, or another of the fatty acid synthase enzyme, is added to reduce conversion of malonyl-CoA to fatty acids. For example, the inhibitor cerulenin is added at a concentration that inhibits one or more enzymes of the fatty acid synthase system. FIG. 2A depicts relevant pathways and shows three inhibitors—thiolactomycin, triclosan, and cerulenin, next to the enzymes that they inhibit. Encircled E. coli gene names indicate a temperature-sensitive mutant is available for the polypeptide encoded by the gene. FIG. 2B provides a more detailed depiction of representative enzymatic conversions and exemplary E. coli genes of the fatty acid synthetase system that was more generally depicted in FIG. 2A. This listing of inhibitors of microorganism fatty acid synthetase enzymes is not meant to be limiting. Other inhibitors, some of which are used as antibiotics, are known in the art and include, but are not limited to, diazaborines such as thienodiazaborine, and, isoniazid.

The 3-HP tolerance aspects of the present invention can be used with any microorganism that makes 3-HP, whether that organism makes 3-HP naturally or has been genetically modified by any method to produce 3-HP.

As to the 3-HP production increase aspects of the invention, which may result in elevated titer of 3-HP in industrial bio-production, the genetic modifications comprise introduction of one or more nucleic acid sequences into a microorganism, wherein the one or more nucleic acid sequences encode for and express one or more production pathway enzymes (or enzymatic activities of enzymes of a production pathway). In various embodiments these improvements thereby combine to increase the efficiency and efficacy of, and consequently to lower the costs for, the industrial bio-production production of 3-HP.

Any one or more of a number of 3-HP production pathways may be used in a microorganism such as in combination with genetic modifications directed to improve 3-HP tolerance. In various embodiments genetic modifications are made to provide enzymatic activity for implementation of one or more of such 3-HP production pathways. Several 3-HP production pathways are known in the art. For example, U.S. Pat. No. 6,852,517 teaches a 3-HP production pathway from glycerol as carbon source, and is incorporated by reference for its teachings of that pathway. This reference teaches providing a genetic construct which expresses the dhaB gene from Klebsiella pneumoniae and a gene for an aldehyde dehydrogenase. These are stated to be capable of catalyzing the production of 3-HP from glycerol. However, it is recognized that in some embodiments the carbon source for a bio-production of 3-HP excludes glycerol as a major portion of the carbon source.

WO 2002/042418 teaches several 3-HP production pathways. This PCT publication is incorporated by reference for its teachings of such pathways. Also, FIG. 44 of that publication, which summarizes a 3-HP production pathway from glucose to pyruvate to acetyl-CoA to malonyl-CoA to 3-HP, is provided herein. FIG. 55 of that publication, which summarizes a 3-HP production pathway from glucose to phosphoenolpyruvate (PEP) to oxaloacetate (directly or via pyruvate) to aspartate to β-alanine to malonate semialdehyde to 3-HP, is provided herein. Representative enzymes for various conversions are also shown in these figures.

Figure 13:
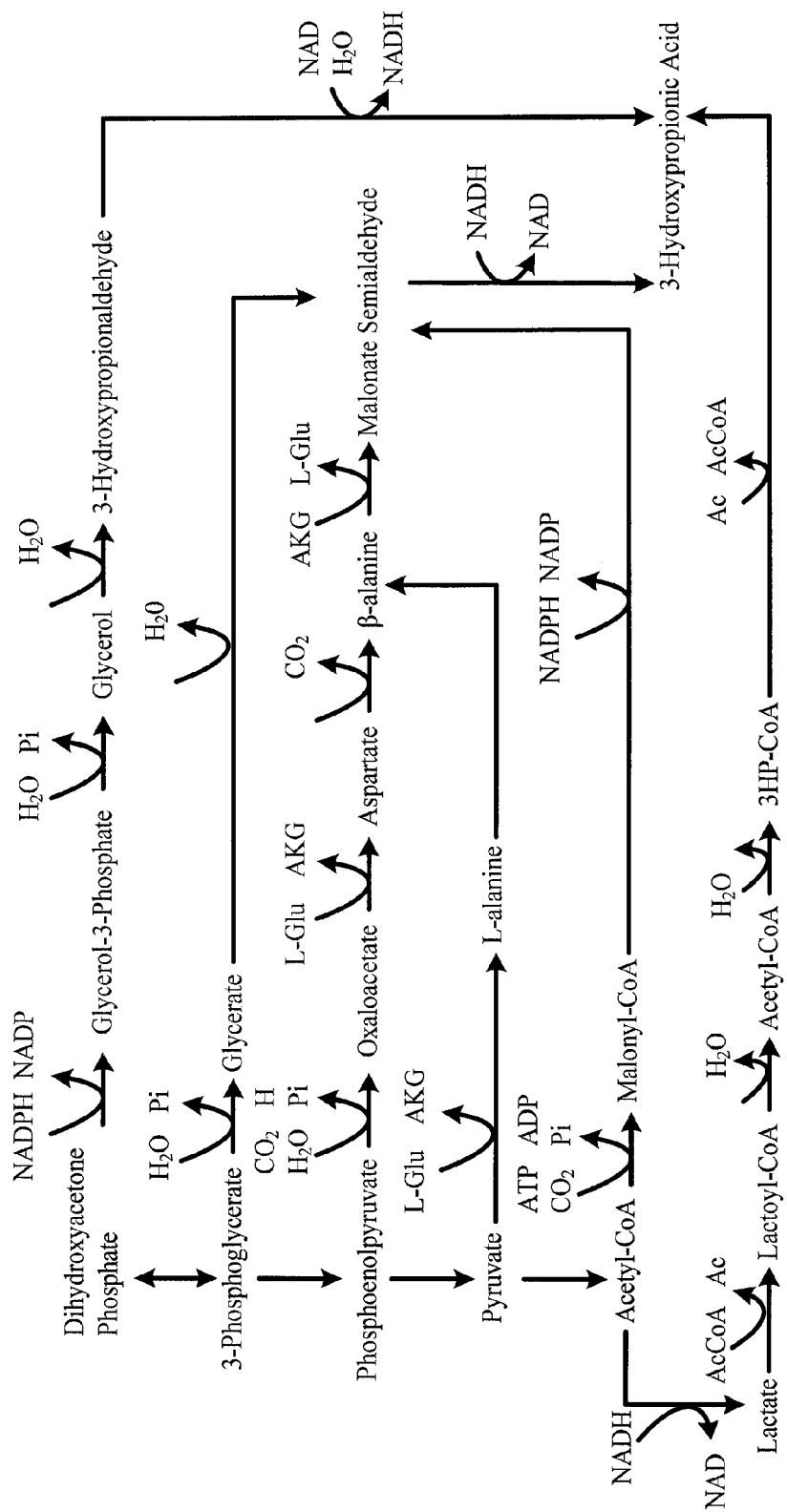
FIG. 13 provides, from a prior art reference, a summary of known 3-HP production pathways.

FIG. 13, from U.S. Patent Publication No. US2008/0199926, published Aug. 21, 2008 and incorporated by reference herein, summarizes the herein-described 3-HP production pathways and other known natural pathways. More generally as to developing specific metabolic pathways, of which many may be not found in nature, Hatzimanikatis et al. discuss this in "Exploring the diversity of complex metabolic networks," Bioinformatics 21(8):1603-1609 (2005). This article is incorporated by reference for its teachings of the complexity of metabolic networks.

Further to the 3-HP production pathway summarized in the figures, Strauss and Fuchs ("Enzymes of a novel autotrophic $CO_2$ fixation pathway in the phototrophic bacterium *Chloroflexus aurantiacus*, the 3-hydroxyproprionate cycle," Eur. J. Bichem. 215, 633-643 (1993)) identified a natural bacterial pathway that produced 3-HP. At that time the authors stated the conversion of malonyl-CoA to malonate semialdehyde was by an NADP-dependant acylating malonate semialdehyde dehydrogenase and conversion of malonate semialdehyde to 3-HP was catalyzed by a 3-hydroxyproprionate dehydrogenase. However, since that time it has become appreciated that, at least for *Chloroflexus aurantiacus*, a single enzyme may catalyze both steps (M. Hugler et al., "Malonyl-Coenzyme A Reductase from *Chloroflexus aurantiacus*, a Key Enzyme of the 3-Hydroxypropionate Cycle for Autotrophic $CO_2$ Fixation," J. Bacter, 184(9):2404-2410 (2002)).

Accordingly, one production pathway of various embodiments of the present invention comprises malonyl-Co-A reductase enzymatic activity that achieves conversions of malonyl-CoA to malonate semialdehyde to 3-HP. As provided in an example herein, introduction into a microorganism of a nucleic acid sequence encoding a polypeptide providing this enzyme (or enzymatic activity) is effective to provide increased 3-HP biosynthesis.

Another 3-HP production pathway is provided in FIG. 14B (FIG. 14A showing the natural mixed fermentation pathways) and explained in this and following paragraphs. This is a 3-HP production pathway that may be used with or independently of other 3-HP production pathways. One possible way to establish this biosynthetic pathway in a recombinant microorganism, one or more nucleic acid sequences encoding an oxaloacetate alpha-decarboxylase (oad-2) enzyme (or respective or related enzyme having such activity) is introduced into a microorganism and expressed. As exemplified in the Examples, which are not meant to be limiting, enzyme evolution techniques are applied to enzymes having a desired catalytic role for a structurally similar substrate, so as to obtain an evolved (e.g., mutated) enzyme (and corresponding nucleic acid sequence(s) encoding it), that exhibits the desired catalytic reaction at a desired rate and specificity in a microorganism.

Thus, for various embodiments of the invention the genetic manipulations to any pathways of the 3HPTCG and any of the 3-HP bio-production pathways may be described to include various genetic manipulations, including those directed to change regulation of, and therefore ultimate activity of, an enzyme or enzymatic activity of an enzyme identified in any of the respective pathways. Such genetic modifications may be directed to transcriptional, translational, and post-translational modifications that result in a change of enzyme activity and/or selectivity under selected and/or identified culture conditions. Thus, in various embodiments, to function more efficiently, a microorganism may comprise one or more gene deletions. For example, as summarized in FIG. 14B for a particular embodiment in *E. coli*, the genes encoding lactate dehydrogenase (ldhA), phosphate acetyltransferase (pta), pyruvate oxidase (poxB) and pyruvate-formate lyase (pflB) may be deleted. Such gene deletions are summarized at the bottom of FIG. 14B for a particular embodiment, which is not meant to be limiting. Additionally, a further deletion or other modification to reduce enzymatic activity, of multifunctional 2-keto-3-deoxygluconate 6-phosphate aldolase and 2-keto-4-hydroxyglutarate aldolase and oxaloacetate decarboxylase (eda in *E. coli*), may be provided to various strains. Further to the latter, in various embodiments combined with such reduction of enzymatic activity of multifunctional 2-keto-3-deoxygluconate 6-phosphate aldolase and 2-keto-4-hydroxyglutarate aldolase and oxaloacetate decarboxylase (eda in *E. coli*), further genetic modifications may be made to increase a glucose transporter (e.g. galP in *E. coli*) and/or to decrease activity of one or more of heat stable, histidyl phosphorylatable protein (of PTS) (ptsH (HPr) in *E. coli*), phosphoryl transfer protein (of PTS) (ptsI in *E. coli*), and the polypeptide chain of PTS (Crr in *E. coli*).

Gene deletions may be accomplished by mutational gene deletion approaches, and/or starting with a mutant strain having reduced or no expression of one or more of these enzymes, and/or other methods known to those skilled in the art.

Aspects of the invention also regard provision of multiple genetic modifications to improve microorganism overall effectiveness in converting a selected carbon source into a chemical product such as 3-HP. Particular combinations are shown, such as in the Examples, to increase specific productivity, volumetric productivity, titer and yield substantially over more basic combinations of genetic modifications.

Figure 8:
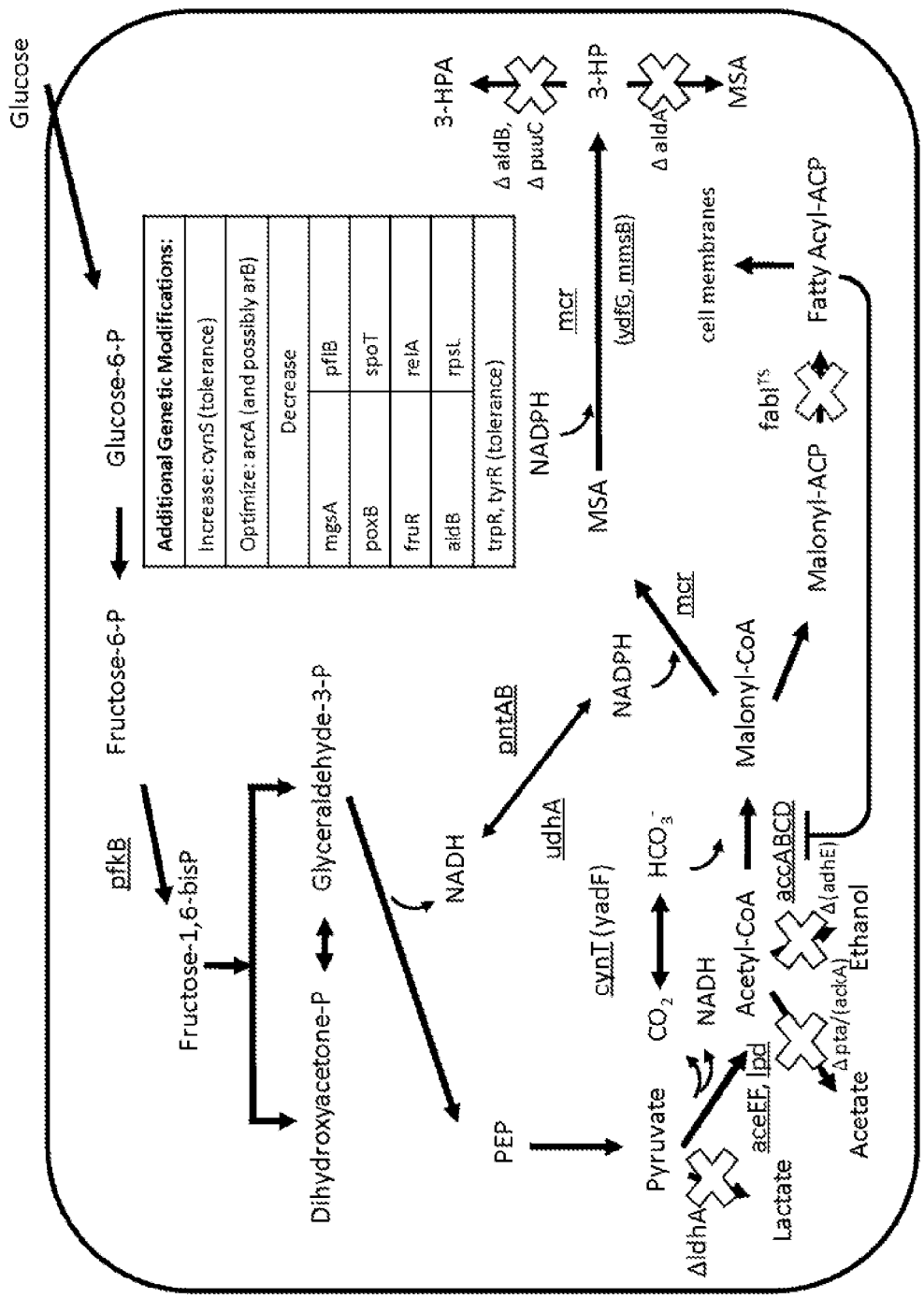
FIG. 8 depicts metabolic pathways of a microorganism with multiple genetic modifications related to aspects of the present invention, more particularly related to 3-HP production, with gene names of *E. coli* shown at certain enzymatic steps, the latter for example and not meant to be limiting.

Further to FIG. 9 genetic modifications, appropriate additional genetic modifications can provide further improved production metrics. For example, a genetically modified strain is depicted in FIG. 8. This strain comprises genetic modifications for 3-HP production (such as described above in Section VII above), 3-HP tolerance (such as described below), and additional genetic modifications as disclosed herein (including a particular genetic modification regarding the fatty acid synthase system, not to be limiting, such modifications more generally disclosed elsewhere herein including in Section VI). In this figure enzyme functions are indicated by indicated enzymatic conversions and/or representative E. coli gene identifiers that encode proteins having such enzyme functions (except that mcr indicates non-E. coli malonyl-CoA reductase), deletions are shown by the standard "Δ" before the respective gene identifier, and increased enzymatic activities are shown by underlining (noting that additional targets for modifications are as indicated in the embedded table of the figure). Genes in parentheses are possible substitutes for or supplements of an enzyme encoded by another gene also shown along the respective pathway step. Also, the use of fabI$^{TS}$ represents a substitution for the native non-temperature-sensitive gene. This is not meant to be limiting; as described elsewhere there are a number of approaches to control and limit flux to fatty acyl-ACP.

The embodiment of FIG. 8 depicts a number of genetic modifications in combination, however in various embodiments of the present invention other combinations of the genetic modifications of these enzymatic functions may be provided to achieve a desired level of increased rate, titer and yield as to bio-production of a chemical product.

Additional genetic modifications may be provided in a microorganism strain of the present invention. Many such modifications may be provided to impart a particular phenotype.

As one example, a deletion, of multifunctional 2-keto-3-deoxygluconate 6-phosphate aldolase and 2-keto-4-hydroxyglutarate aldolase and oxaloacetate decarboxylase (eda in E. coli), may be provided to various strains.

For example, the ability to utilize sucrose may be provided, and this would expand the range of feed stocks that can be utilized to produce 3-HP or other chemical products. Common laboratory and industrial strains of E. coli, such as the strains described herein, are not capable of utilizing sucrose as the sole carbon source. Since sucrose, and sucrose-containing feed stocks such as molasses, are abundant and often used as feed stocks for the production by microbial fermentation, adding appropriate genetic modifications to permit uptake and use of sucrose may be practiced in strains having other features as provided herein. Various sucrose uptake and metabolism systems are known in the art (for example, U.S. Pat. No. 6,960,455), incorporated by reference for such teachings. These and other approaches may be provided in strains of the present invention. The examples provide at least two approaches.

Also, genetic modifications may be provided to add functionality for breakdown of more complex carbon sources, such as cellulosic biomass or products thereof, for uptake, and/or for utilization of such carbon sources. For example, numerous cellulases and cellulase-based cellulose degradation systems have been studied and characterized (see, for example, and incorporated by reference herein for such teachings, Beguin, P and Aubert, J-P (1994) FEMS Microbial. Rev. 13: 25-58; Ohima, K. et al. (1997) Biotechnol. Genet. Eng. Rev. 14: 365414).

In addition to the above-described genetic modifications, in various embodiments genetic modifications also are provided to increase the pool and availability of the cofactor NADPH, and/or, consequently, the NADPH/NADP$^+$ ratio. For example, in various embodiments for E. coli, this may be done by increasing activity, such as by genetic modification, of one or more of the following genes-pgi (in a mutated form), pntAB, overexpressed, gapA:gapN substitution/replacement, and disrupting or modifying a soluble transhydrogenase such as sthA, and/or genetic modifications of one or more of zwf, gnd, and edd.

Any such genetic modifications may be provided to species not having such functionality, or having a less than desired level of such functionality.

More generally, and depending on the particular metabolic pathways of a microorganism selected for genetic modification, any subgroup of genetic modifications may be made to decrease cellular production of fermentation product(s) selected from the group consisting of acetate, acetoin, acetone, acrylic, malate, fatty acid ethyl esters, isoprenoids, glycerol, ethylene glycol, ethylene, propylene, butylene, isobutylene, ethyl acetate, vinyl acetate, other acetates, 1,4-butanediol, 2,3-butanediol, butanol, isobutanol, sec-butanol, butyrate, isobutyrate, 2-OH-isobutryate, 3-OH-butyrate, ethanol, isopropanol, D-lactate, L-lactate, pyruvate, itaconate, levulinate, glucarate, glutarate, caprolactam, adipic acid, propanol, isopropanol, fusel alcohols, and 1,2-propanediol, 1,3-propanediol, formate, fumaric acid, propionic acid, succinic acid, valeric acid, and maleic acid. Gene deletions may be made as disclosed generally herein, and other approaches may also be used to achieve a desired decreased cellular production of selected fermentation products.

X. Separation and Purification of the Chemical Product 3-HP

When 3-HP is the chemical product, the 3-HP may be separated and purified by the approaches described in the following paragraphs, taking into account that many methods of separation and purification are known in the art and the following disclosure is not meant to be limiting. Osmotic shock, sonication, homogenization, and/or a repeated freeze-thaw cycle followed by filtration and/or centrifugation, among other methods, such as pH adjustment and heat treatment, may be used to produce a cell-free extract from intact cells. Any one or more of these methods also may be employed to release 3-HP from cells as an extraction step.

Further as to general processing of a bio-production broth comprising 3-HP, various methods may be practiced to remove biomass and/or separate 3-HP from the culture broth and its components. Methods to separate and/or concentrate the 3-HP include centrifugation, filtration, extraction, chemical conversion such as esterification, distillation (which may result in chemical conversion, such as dehydration to acrylic acid, under some reactive-distillation conditions), crystallization, chromatography, and ion-exchange, in various forms. Additionally, cell rupture may be conducted as needed to release 3-HP from the cell mass, such as by sonication, homogenization, pH adjustment or heating. 3-HP may be further separated and/or purified by methods known in the art, including any combination of one or more of centrifugation, liquid-liquid separations, including extractions such as solvent extraction, reactive extraction, two-phase aqueous extraction and two-phase solvent extraction, membrane separation technologies, distillation, evaporation, ion-exchange chromatography, adsorption chromatography, reverse phase chromatography and crystallization. Any of the above methods may be applied to a portion of a bio-production broth (i.e., a fermentation broth, whether made under aerobic, anaerobic, or microaerobic conditions), such as may be removed from a bio-production event gradually or periodically, or to the broth at termination of a bio-production event. Conversion of 3-HP to downstream products, such as described herein, may proceed after separation and purification, or, such as with distillation, thin-film evaporation, or wiped-film evaporation optionally also in part as a separation means.

For various of these approaches, one may apply a countercurrent strategy, or a sequential or iterative strategy, such as multi-pass extractions. For example, a given aqueous solution comprising 3-HP may be repeatedly extracted with a non-polar phase comprising an amine to achieve multiple reactive extractions.

When a culture event (fermentation event) is at a point of completion, the spent broth may transferred to a separate tank, or remain in the culture vessel, and in either case the temperature may be elevated to at least 60° C. for a minimum of one hour in order to kill the microorganisms. (Alternatively, other approaches to killing the microorganisms may be practiced.) By spent broth is meant the final liquid volume comprising the initial nutrient media, cells grown from the microorganism inoculum (and possibly including some original cells of the inoculum), 3-HP, and optionally liquid additions made after providing the initial nutrient media, such as periodic additions to provide additional carbon source, etc. It is noted that the spent broth may comprise organic acids other than 3-HP, such as for example acetic acid and/or lactic acid.

A centrifugation step may then be practiced to filter out the biomass solids (e.g., microorganism cells). This may be achieved in a continuous or batch centrifuge, and solids removal may be at least about 80%, 85%, 90%, or 95% in a single pass, or cumulatively after two or more serial centrifugations.

An optional step is to polish the centrifuged liquid through a filter, such as microfiltration or ultrafiltration, or may comprise a filter press or other filter device to which is added a filter aid such as diatomaceous earth. Alternative or supplemental approaches to this and the centrifugation may include removal of cells by a flocculent, where the cells floc and are allowed to settle, and the liquid is drawn off or otherwise removed. A flocculent may be added to a fermentation broth after which settling of material is allowed for a time, and then separations may be applied, including but not limited to centrifugation.

After such steps, a spent broth comprising 3-HP and substantially free of solids is obtained for further processing. By "substantially free of solids" is meant that greater than 98%, 99%, or 99.5% of the solids have been removed.

In various embodiments this spent broth comprises various ions of salts, such as Na, Cl, $SO_4$, and $PO_4$. In some embodiments these ions may be removed by passing this spent broth through ion exchange columns, or otherwise contacting the spent broth with appropriate ion exchange material. Here and elsewhere in this document, "contacting" is taken to mean a contacting for the stated purpose by any way known to persons skilled in the art, such as, for example, in a column, under appropriate conditions that are well within the ability of persons of ordinary skill in the relevant art to determine. As but one example, these may comprise sequential contacting with anion and cation exchange materials (in any order), or with a mixed anion/cation material. This demineralization step should remove most such inorganic ions without removing the 3-HP. This may be achieved, for example, by lowering the pH sufficiently to protonate 3-HP and similar organic acids so that these acids are not bound to the anion exchange material, whereas anions, such as Cl and $SO_4$, that remain charged at such pH are removed from the solution by binding to the resin. Likewise, positively charged ions are removed by contacting with cation exchange material. Such removal of ions may be assessed by a decrease in conductivity of the solution. Such ion exchange materials may be regenerated by methods known to those skilled in the art.

In some embodiments, the spent broth (such as but not necessarily after the previous demineralization step) is subjected to a pH elevation, after which it is passed through an ion exchange column, or otherwise contacted with an ion exchange resin, that comprises anionic groups, such as amines, to which organic acids, ionic at this pH, associate. Other organics that do not so associate with amines at this pH (which may be over 6.5, over 7.5, over 8.5, over 9.5, over 10.5, or higher pH) may be separated from the organic acids at this stage, such as by flushing with an elevated pH rinse. Thereafter elution with a lower pH and/or elevated salt content rinse may remove the organic acids. Eluting with a gradient of decreasing pH and/or increasing salt content rinses may allow more distinct separation of 3-HP from other organic acids, thereafter simplifying further processing.

This latter step of anion-exchange resin retention of organic acids may be practiced before or after the demineralization step. However, the following two approaches are alternatives to the anion-exchange resin step.

A first alternative approach comprises reactive extraction (a form of liquid-liquid extraction) as exemplified in this and the following paragraphs. The spent broth, which may be at a stage before or after the demineralization step above, is combined with a quantity of a tertiary amine such as Alamine-336® (Cognis Corp., Cincinnati, Ohio USA) at low pH. Co-solvents for the Alamine-336 or other tertiary amine may be added and include, but are not limited to benzene, carbon tetrachloride, chloroform, cyclohexane, disobutyl ketone, ethanol, #2 fuel oil, isopropanol, kerosene, n-butanol, isobutanol, octanol, and n-decanol that increase the partition coefficient when combined with the amine. After appropriate mixing a period of time for phase separation transpires, after which the non-polar phase, which comprises 3-HP associated with the Alamine-336 or other tertiary amine, is separated from the aqueous phase.

When a co-solvent is used that has a lower boiling point than the 3-HP/tertiary amine, a distilling step may be used to remove the co-solvent, thereby leaving the 3-HP-tertiary amine complex in the non-polar phase.

Whether or not there is such a distillation step, a stripping or recovery step may be used to separate the 3-HP from the tertiary amine. An inorganic salt, such as ammonium sulfate, sodium chloride, or sodium carbonate, or a base such as sodium hydroxide or ammonium hydroxide, is added to the 3-HP/tertiary amine to reverse the amine protonation reaction, and a second phase is provided by addition of an aqueous solution (which may be the vehicle for provision of the inorganic salt). After suitable mixing, two phases result and this allows for tertiary amine regeneration and re-use, and provides the 3-HP in an aqueous solution. Alternatively, hot water may also be used without a salt or base to recover the 3HP from the amine.

In the above approach the phase separation and extraction of 3-HP to the aqueous phase can serve to concentrate the 3-HP. It is noted that chromatographic separation of respective organic acids also can serve to concentrate such acids, such as 3-HP. In similar approaches other suitable, non-polar amines, which may include primary, secondary and quaternary amines, may be used instead of and/or in combination with a tertiary amine.

A second alternative approach is crystallization. For example, the spent broth (such as free of biomass solids) may be contacted with a strong base such as ammonium hydroxide, which results in formation of an ammonium salt of 3-HP. This may be concentrated, and then ammonium-3-HP crystals are formed and may be separated, such as by filtration, from the aqueous phase. Once collected, ammonium-3-HP crystals may be treated with an acid, such as sulfuric acid, so that ammonium sulfate is regenerated, so that 3-HP and ammonium sulfate result.

Also, various aqueous two-phase extraction methods may be utilized to separate and/or concentrate a desired chemical product from a fermentation broth or later-obtained solution. It is known that the addition of polymers, such as dextran and glycol polymers, such as polyethylene glycol (PEG) and polypropylene glycol (PPG) to an aqueous solution may result in formation of two aqueous phases. In such systems a desired chemical product may segregate to one phase while cells and other chemicals partition to the other phase, thus providing for a separation without use of organic solvents. This approach has been demonstrated for some chemical products, but challenges associated with chemical product recovery from a polymer solution and low selectivities are recognized (See "Extractive Recovery of Products from Fermentation Broths," Joong Kyun Kim et al., Biotechnol. Bioprocess Eng., 1999(4)1-11, incorporated by reference for all of its teachings of extractive recovery methods).

Various substitutions and combinations of the above steps and processes may be made to obtain a relatively purified 3-HP solution. Also, methods of separation and purification disclosed in U.S. Pat. No. 6,534,679, issued Mar. 18, 2003, and incorporated by reference herein for such methods disclosures, may be considered based on a particular processing scheme. Also, in some culture events periodic removal of a portion of the liquid volume may be made, and processing of such portion(s) may be made to recover the 3-HP, including by any combination of the approaches disclosed above.

As noted, solvent extraction is another alternative. This may use any of a number of and/or combinations of solvents, including alcohols, esters, ketones, and various organic solvents. Without being limiting, after phase separation a distillation step or a secondary extraction may be employed to separate 3-HP from the organic phase.

The following published resources are incorporated by reference herein for their respective teachings to indicate the level of skill in these relevant arts, and as needed to support a disclosure that teaches how to make and use methods of industrial bio-production of 3-HP, and also industrial systems that may be used to achieve such conversion with any of the recombinant microorganisms of the present invention (*Biochemical Engineering Fundamentals*, $2^{nd}$ Ed. J. E. Bailey and D. F. Ollis, McGraw Hill, New York, 1986, entire book for purposes indicated and Chapter 9, pp. 533-657 in particular for biological reactor design; Unit Operations of Ed., $5^{th}$ Ed. *Chemical Engineering*, $5^{th}$ Ed., W. L. McCabe et al., McGraw Hill, New York 1993, entire book for purposes indicated, and particularly for process and separation technologies analyses; *Equilibrium Staged Separations*, P. C. Wankat, Prentice Hall, Englewood Cliffs, N.J. USA, 1988, entire book for separation technologies teachings).

XI. Conversion of 3-HP to Acrylic Acid and Downstream Products

As discussed herein, various embodiments described herein are related to production of a particular chemical product, 3-hydroxypropionic acid (3-HP). This organic acid, 3-HP, may be converted to various other products having industrial uses, such as but not limited to acrylic acid, esters of acrylic acid, and other chemicals obtained from 3-HP, referred to as "downstream products." Under some approaches the 3-HP may be converted to acrylic acid, acrylamide, and/or other downstream chemical products, in some instances the conversion being associated with the separation and/or purification steps. Many conversions to such downstream products are described herein. The methods of the invention include steps to produce downstream products of 3-HP.

As a $C_3$ building block, 3-HP offers much potential in a variety of chemical conversions to commercially important intermediates, industrial end products, and consumer products. For example, 3-HP may be converted to acrylic acid, acrylates (e.g., acrylic acid salts and esters), 1,3-propanediol, malonic acid, ethyl-3-hydroxypropionate, ethyl ethoxy propionate, propiolactone, acrylamide, or acrylonitrile.

For example, methyl acrylate may be made from 3-HP via dehydration and esterification, the latter to add a methyl group (such as using methanol); acrylamide may be made from 3-HP via dehydration and amidation reactions; acrylonitrile may be made via a dehydration reaction and forming a nitrile moiety; propriolactone may be made from 3-HP via a ring-forming internal esterification reaction (eliminating a water molecule); ethyl-3-HP may be made from 3-HP via esterification with ethanol; malonic acid may be made from 3-HP via an oxidation reaction; and 1,3-propanediol may be made from 3-HP via a reduction reaction. Also, acrylic acid, first converted from 3-HP by dehydration, may be esterified with appropriate compounds to form a number of commercially important acrylate-based esters, including but not limited to methyl acrylate, ethyl acrylate, methyl acrylate, 2-ethylhexyl acrylate, butyl acrylate, and lauryl acrylate. Alternatively, 3HP may be esterified to form an ester of 3HP and then dehydrated to form the acrylate ester.

Additionally, 3-HP may be oligomerized or polymerized to form poly(3-hydroxypropionate) homopolymers, or co-polymerized with one or more other monomers to form various co-polymers. Because 3-HP has only a single stereoisomer, polymerization of 3-HP is not complicated by the stereospecificity of monomers during chain growth. This is in contrast to (S)-2-Hydroxypropanoic acid (also known as lactic acid), which has two (D, L) stereoisomers that must be considered during its polymerizations.

As will be further described, 3-HP can be converted into derivatives starting (i) substantially as the protonated form of 3-hydroxypropionic acid; (ii) substantially as the deprotonated form, 3-hydroxypropionate; or (iii) as mixtures of the protonated and deprotonated forms. Generally, the fraction of 3-HP present as the acid versus the salt will depend on the pH, the presence of other ionic species in solution, temperature (which changes the equilibrium constant relating the acid and salt forms), and to some extent pressure. Many chemical conversions may be carried out from either of the 3-HP forms, and overall process economics will typically dictate the form of 3-HP for downstream conversion.

Also, as an example of a conversion during separation, 3-HP in an amine salt form, such as in the extraction step herein disclosed using Alamine 336 as the amine, may be converted to acrylic acid by contacting a solution comprising the 3-HP amine salt with a dehydration catalyst, such as aluminum oxide, at an elevated temperature, such as 170 to 180 C, or 180 to 190 C, or 190 to 200 C, and passing the collected vapor phase over a low temperature condenser. Operating conditions, including 3-HP concentration, organic amine, co-solvent (if any), temperature, flow rates, dehydration catalyst, and condenser temperature, are evaluated and improved for commercial purposes. Conversion of 3-HP to acrylic acid is expected to exceed at least 80 percent, or at least 90 percent, in a single conversion event. The amine may be re-used, optionally after clean-up. Other dehydration catalysts, as provided herein, may be evaluated. It is noted that U.S. Pat. No. 7,186,856 discloses data regarding this conversion approach, albeit as part of an extractive salt-splitting conversion that differs from the teachings herein. However, U.S. Pat. No. 7,186,856 is incorporated by reference for its methods, including extractive salt-splitting, the latter to further indicate the various ways 3-HP may be extracted from a microbial fermentation broth.

Further as to embodiments in which the chemical product being synthesized by the microorganism host cell is 3-HP, made as provided herein and optionally purified to a selected purity prior to conversion, the methods of the present invention can also be used to produce "downstream" compounds derived from 3-HP, such as polymerized-3-HP (poly-3-HP), acrylic acid, polyacrylic acid (polymerized acrylic acid, in various forms), methyl acrylate, acrylamide, acrylonitrile, propiolactone, ethyl 3-HP, malonic acid, and 1,3-propanediol. Numerous approaches may be employed for such downstream conversions, generally falling into enzymatic, catalytic (chemical conversion process using a catalyst), thermal, and combinations thereof (including some wherein a desired pressure is applied to accelerate a reaction).

As noted, an important industrial chemical product that may be produced from 3-HP is acrylic acid. Chemically, one of the carbon-carbon single bonds in 3-HP must undergo a dehydration reaction, converting to a carbon-carbon double bond and rejecting a water molecule. Dehydration of 3-HP in principle can be carried out in the liquid phase or in the gas phase. In some embodiments, the dehydration takes place in the presence of a suitable homogeneous or heterogeneous catalyst. Suitable dehydration catalysts are both acid and alkaline catalysts. Following dehydration, an acrylic acid-containing phase is obtained and can be purified where appropriate by further purification steps, such as by distillation methods, extraction methods, or crystallization methods, or combinations thereof.

Making acrylic acid from 3-HP via a dehydration reaction may be achieved by a number of commercial methodologies including via a distillation process, which may be part of the separation regime and which may include an acid and/or a metal ion as catalyst. More broadly, incorporated herein for its teachings of conversion of 3-HP, and other β-hydroxy carbonyl compounds, to acrylic acid and other related downstream compounds, is U.S. Patent Publication No. 2007/0219390 A1, published Sep. 20, 2007, now abandoned. This publication lists numerous catalysts and provides examples of conversions, which are specifically incorporated herein. Also among the various specific methods to dehydrate 3-HP to produce acrylic acid is an older method, described in U.S. Pat. No. 2,469,701 (Redmon). This reference teaches a method for the preparation of acrylic acid by heating 3-HP to a temperature between 130 and 190° C., in the presence of a dehydration catalyst, such as sulfuric acid or phosphoric acid, under reduced pressure. U.S. Patent Publication No. 2005/0222458 A1 (Craciun et al.) also provides a process for the preparation of acrylic acid by heating 3-HP or its derivatives. Vapor-phase dehydration of 3-HP occurs in the presence of dehydration catalysts, such as packed beds of silica, alumina, or titania. These patent publications are incorporated by reference for their methods relating to converting 3-HP to acrylic acid.

The dehydration catalyst may comprise one or more metal oxides, such as $Al_2O_3$, $SiO_2$, or $TiO_2$. In some embodiments, the dehydration catalyst is a high surface area $Al_2O_3$ or a high surface area silica wherein the silica is substantially $SiO_2$. High surface area for the purposes of the invention means a surface area of at least about 50, 75, 100 $m^2/g$, or more. In some embodiments, the dehydration catalyst may comprise an aluminosilicate, such as a zeolite.

For example, including as exemplified from such incorporated references, 3-HP may be dehydrated to acrylic acid via various specific methods, each often involving one or more dehydration catalysts. One catalyst of particular apparent value is titanium, such as in the form of titanium oxide, TiO(2). A titanium dioxide catalyst may be provided in a dehydration system that distills an aqueous solution comprising 3-HP, wherein the 3-HP dehydrates, such as upon volatilization, converting to acrylic acid, and the acrylic acid is collected by condensation from the vapor phase.

As but one specific method, an aqueous solution of 3-HP is passed through a reactor column packed with a titanium oxide catalyst maintained at a temperature between 170 and 190 C and at ambient atmospheric pressure. Vapors leaving the reactor column are passed over a low temperature condenser, where acrylic acid is collected. The low temperature condenser may be cooled to 30 C or less, 2 C or less, or at any suitable temperature for efficient condensation based on the flow rate and design of the system. Also, the reactor column temperatures may be lower, for instance when operating at a pressure lower than ambient atmospheric pressure. It is noted that Example 1 of U.S. Patent Publication No. 2007/0219390, published Sep. 20, 2007, now abandoned, provides specific parameters that employs the approach of this method. As noted, this publication is incorporated by reference for this teaching and also for its listing of catalysts that may be used in a 3-HP to acrylic acid dehydration reaction.

Further as to dehydration catalysts, the following table summarizes a number of catalysts (including chemical classes) that may be used in a dehydration reaction from 3-HP (or its esters) to acrylic acid (or acrylate esters). Such catalysts, some of which may be used in any of solid, liquid or gaseous forms, may be used individually or in any combination. This listing of catalysts is not intended to be limiting, and many specific catalysts not listed may be used for specific dehydration reactions. Further without being limiting, catalyst selection may depend on the solution pH and/or the form of 3-HP in a particular conversion, so that an acidic catalyst may be used when 3-HP is in acidic form, and a basic catalyst may be used when the ammonium salt of 3-HP is being converted to acrylic acid. Also, some catalysts may be in the form of ion exchange resins.

TABLE 8

Dehydration Catalysts

| Catalyst by Chemical Class | Non-limiting Examples |
|---|---|
| Acids (including weak and strong) | $H_2SO_4$, HCl, titanic acids, metal oxide hydrates, metal sulfates ($MSO_4$, where M = Zn, Sn, Ca, Ba, Ni, Co, or other transition metals), metal oxide sulfates, metal phosphates (e.g., $M_3$, $(PO_4)_2$, where M = Ca, Ba), metal phosphates, metal oxide phosphates, carbon (e.g., transition metals on a carbon support), mineral acids, carboxylic acids, salts thereof, acidic resins, acidic zeolites, clays, $SiO_2/H_3PO_4$, fluorinated $Al_2O_3$, $Nb_2O_3/PO_5^{-3}$, $Nb_2O_3/SO_4^{-2}$, $Nb_2O_5H_2O$, phosphotungstic acids, phosphomolybdic acids, silicomolybdic acids, silicotungstic acids, carbon dioxide |

TABLE 8-continued

Dehydration Catalysts

| Catalyst by Chemical Class | Non-limiting Examples |
|---|---|
| Bases (including weak and strong) | NaOH, ammonia, polyvinylpyridine, metal hydroxides, $Zr(OH)_4$, and substituted amines |
| Oxides (generally metal oxides) | $TiO_2$, $ZrO_2$, $Al_2O_3$, $SiO_2$, $ZnO_2$, $SnO_2$, $WO_3$, $MnO_2$, $Fe_2O_3$, $V_2O_5$ |

As to another specific method using one of these catalysts, concentrated sulfuric acid and an aqueous solution comprising 3-HP are separately flowed into a reactor maintained at 150 to 165° C. at a reduced pressure of 100 mm Hg. Flowing from the reactor is a solution comprising acrylic acid. A specific embodiment of this method, disclosed in Example 1 of US2009/0076297, incorporated by reference herein, indicates a yield of acrylic acid exceeding 95 percent.

Based on the wide range of possible catalysts and knowledge in the art of dehydration reactions of this type, numerous other specific dehydration methods may be evaluated and implemented for commercial production.

The dehydration of 3-HP may also take place in the absence of a dehydration catalyst. For example, the reaction may be run in the vapor phase in the presence of a nominally inert packing such as glass, ceramic, a resin, porcelain, plastic, metallic or brick dust packing and still form acrylic acid in reasonable yields and purity. The catalyst particles can be sized and configured such that the chemistry is, in some embodiments, mass-transfer-limited or kinetically limited. The catalyst can take the form of powder, pellets, granules, beads, extrudates, and so on. When a catalyst support is optionally employed, the support may assume any physical form such as pellets, spheres, monolithic channels, etc. The supports may be co-precipitated with active metal species; or the support may be treated with the catalytic metal species and then used as is or formed into the aforementioned shapes; or the support may be formed into the aforementioned shapes and then treated with the catalytic species.

A reactor for dehydration of 3-HP may be engineered and operated in a wide variety of ways. The reactor operation can be continuous, semi-continuous, or batch. It is perceived that an operation that is substantially continuous and at steady state is advantageous from operations and economics perspectives. The flow pattern can be substantially plug flow, substantially well-mixed, or a flow pattern between these extremes. A "reactor" can actually be a series or network of several reactors in various arrangements.

For example, without being limiting, acrylic acid may be made from 3-HP via a dehydration reaction, which may be achieved by a number of commercial methodologies including via a distillation process, which may be part of the separation regime and which may include an acid and/or a metal ion as catalyst. More broadly, incorporated herein for its teachings of conversion of 3-HP, and other β-hydroxy carbonyl compounds, to acrylic acid and other related downstream compounds, is U.S. Patent Publication No. 2007/0219390 A1, published Sep. 20, 2007, now abandoned. This publication lists numerous catalysts and provides examples of conversions, which are specifically incorporated herein.

For example, including as exemplified from such incorporated references, 3-HP may be dehydrated to acrylic acid via various specific methods, each often involving one or more dehydration catalysts. One catalyst of particular apparent value is titanium, such as in the form of titanium oxide, $TiO_2$.

A titanium dioxide catalyst may be provided in a dehydration system that distills an aqueous solution comprising 3-HP, wherein the 3-HP dehydrates, such as upon volatilization, converting to acrylic acid, and the acrylic acid is collected by condensation from the vapor phase.

As but one specific method, an aqueous solution of 3-HP is passed through a reactor column packed with a titanium oxide catalyst maintained at a temperature between 170 and 190° C. and at ambient atmospheric pressure. Vapors leaving the reactor column are passed over a low temperature condenser, where acrylic acid is collected. The low temperature condenser may be cooled to 30° C. or less, 20° C. or less, 2° C. or less, or at any suitable temperature for efficient condensation based on the flow rate and design of the system. Also, the reactor column temperatures may be lower, for instance when operating at a pressure lower than ambient atmospheric pressure. It is noted that Example 1 of U.S. Patent Publication No. 2007/0219390, published Sep. 20, 2007, now abandoned, provides specific parameters that employs the approach of this method. As noted, this publication is incorporated by reference for this teaching and also for its listing of catalysts that may be used in a 3-HP to acrylic acid dehydration reaction.

Crystallization of the acrylic acid obtained by dehydration of 3-HP may be used as one of the final separation/purification steps. Various approaches to crystallization are known in the art, including crystallization of esters.

As noted above, in some embodiments, a salt of 3-HP is converted to acrylic acid or an ester or salt thereof. For example, U.S. Pat. No. 7,186,856 (Meng et al.) teaches a process for producing acrylic acid from the ammonium salt of 3-HP, which involves a first step of heating the ammonium salt of 3-HP in the presence of an organic amine or solvent that is immiscible with water, to form a two-phase solution and split the 3-HP salt into its respective ionic constituents under conditions which transfer 3-HP from the aqueous phase to the organic phase of the solution, leaving ammonia and ammonium cations in the aqueous phase. The organic phase is then back-extracted to separate the 3-HP, followed by a second step of heating the 3-HP-containing solution in the presence of a dehydration catalyst to produce acrylic acid. U.S. Pat. No. 7,186,856 is incorporated by reference for its methods for producing acrylic acid from salts of 3-HP. Various alternatives to the particular approach disclosed in this patent may be developed for suitable extraction and conversion processes.

Methyl acrylate may be made from 3-HP via dehydration and esterification, the latter to add a methyl group (such as using methanol), acrylamide may be made from 3-HP via dehydration and amidation reactions, acrylonitrile may be made via a dehydration reaction and forming a nitrile moiety, propriolactone may be made from 3-HP via a ring-forming internal esterification reaction (eliminating a water molecule), ethyl-3-HP may be made from 3-HP via esterification with ethanol, malonic acid may be made from 3-HP via an oxidation reaction, and 1,3-propanediol may be made from 3-HP via a reduction reaction.

Malonic acid may be produced from oxidation of 3-HP as produced herein. U.S. Pat. No. 5,817,870 (Haas et al.) discloses catalytic oxidation of 3-HP by a precious metal selected from Ru, Rh, Pd, Os, Ir or Pt. These can be pure metal catalysts or supported catalysts. The catalytic oxidation can be carried out using a suspension catalyst in a suspension reactor or using a fixed-bed catalyst in a fixed-bed reactor. If the catalyst, preferably a supported catalyst, is disposed in a fixed-bed reactor, the latter can be operated in a trickle-bed procedure as well as also in a liquid-phase procedure. In the trickle-bed procedure the aqueous phase comprising the 3-HP starting material, as well as the oxidation products of the same and means for the adjustment of pH, and oxygen or an oxygen-containing gas can be conducted in parallel flow or counter-flow. In the liquid-phase procedure the liquid phase and the gas phase are conveniently conducted in parallel flow.

In order to achieve a sufficiently short reaction time, the conversion is carried out at a pH equal or greater than 6, preferably at least 7, and in particular between 7.5 and 9. According to a preferred embodiment, during the oxidation reaction the pH is kept constant, preferably at a pH in the range between 7.5 and 9, by adding a base, such as an alkaline or alkaline earth hydroxide solution. The oxidation is usefully carried out at a temperature of at least 10° C. and maximally 70° C. The flow of oxygen is not limited. In the suspension method it is important that the liquid and the gaseous phase are brought into contact by stirring vigorously. Malonic acid can be obtained in nearly quantitative yields. U.S. Pat. No. 5,817,870 is incorporated by reference herein for its methods to oxidize 3-HP to malonic acid.

1,3-Propanediol may be produced from hydrogenation of 3-HP as produced herein. U.S. Patent Publication No. 2005/0283029 (Meng et al.) is incorporated by reference herein for its methods to hydrogenation of 3-HP, or esters of the acid or mixtures, in the presence of a specific catalyst, in a liquid phase, to prepare 1,3-propanediol. Possible catalysts include ruthenium metal, or compounds of ruthenium, supported or unsupported, alone or in combination with at least one or more additional metal(s) selected from molybdenum, tungsten, titanium, zirconium, niobium, vanadium or chromium. The ruthenium metal or compound thereof, and/or the additional metal(s), or compound thereof, may be utilized in supported or unsupported form. If utilized in supported form, the method of preparing the supported catalyst is not critical and can be any technique such as impregnation of the support or deposition on the support. Any suitable support may be utilized. Supports that may be used include, but are not limited to, alumina, titania, silica, zirconia, carbons, carbon blacks, graphites, silicates, zeolites, aluminosilicate zeolites, aluminosilicate clays, and the like.

The hydrogenation process may be carried out in liquid phase. The liquid phase includes water, organic solvents that are not hydrogenatable, such as any aliphatic or aromatic hydrocarbon, alcohols, ethers, toluene, decalin, dioxane, diglyme, n-heptane, hexane, xylene, benzene, tetrahydrofuran, cyclohexane, methylcyclohexane, and the like, and mixtures of water and organic solvent(s). The hydrogenation process may be carried out batch wise, semi-continuously, or continuously. The hydrogenation process may be carried out in any suitable apparatus. Exemplary of such apparatus are stirred tank reactors, trickle-bed reactors, high pressure hydrogenation reactors, and the like.

The hydrogenation process is generally carried out at a temperature ranging from about 20 to about 250° C., more particularly from about 100 to about 200° C. Further, the hydrogenation process is generally carried out in a pressure range of from about 20 psi to about 4000 psi. The hydrogen containing gas utilized in the hydrogenation process is, optionally, commercially pure hydrogen. The hydrogen containing gas is usable if nitrogen, gaseous hydrocarbons, or oxides of carbon, and similar materials, are present in the hydrogen containing gas. For example, hydrogen from synthesis gas (hydrogen and carbon monoxide) may be employed, such synthesis gas potentially further including carbon dioxide, water, and various impurities.

As is known in the art, it is also possible to convert 3-HP to 1,3-propanediol using biological methods. For example, 1,3-propanediol can be created from either 3-HP-CoA or 3-HP via the use of polypeptides having enzymatic activity. These polypeptides can be used either in vitro or in vivo. When converting 3-HP-CoA to 1,3-propanediol, polypeptides having oxidoreductase activity or reductase activity (e.g., enzymes from the 1.1.1.-class of enzymes) can be used. Alternatively, when creating 1,3-propanediol from 3-HP, a combination of a polypeptide having aldyhyde dehydrogenase activity (e.g., an enzyme from the 1.1.1.34 class) and a polypeptide having alcohol dehydrogenase activity (e.g., an enzyme from the 1.1.1.32 class) can be used.

Another downstream production of 3-HP, acrylonitrile, may be converted from acrylic acid by various organic syntheses, including by not limited to the Sohio acrylonitrile process, a single-step method of production known in the chemical manufacturing industry Also, addition reactions may yield acrylic acid or acrylate derivatives having alkyl or aryl groups at the carbonyl hydroxyl group. Such additions may be catalyzed chemically, such as by hydrogen, hydrogen halides, hydrogen cyanide, or Michael additions under alkaline conditions optionally in the presence of basic catalysts. Alcohols, phenols, hydrogen sulfide, and thiols are known to add under basic conditions. Aromatic amines or amides, and aromatic hydrocarbons, may be added under acidic conditions. These and other reactions are described in Ulmann's Encyclopedia of Industrial Chemistry, Acrylic Acid and Derivatives, WileyVCH Verlag GmbH, Wienham (2005), incorporated by reference for its teachings of conversion reactions for acrylic acid and its derivatives.

Acrylic acid obtained from 3-HP made by the present invention may be further converted to various chemicals, including polymers, which are also considered downstream products in some embodiments. Acrylic acid esters may be formed from acrylic acid (or directly from 3-HP) such as by condensation esterification reactions with an alcohol, releasing water. This chemistry described in Monomeric Acrylic Esters, E. H. Riddle, Reinhold, N.Y. (1954), incorporated by reference for its esterification teachings. Among esters that are formed are methyl acrylate, ethyl acrylate, n-butyl acrylate, hydroxypropyl acrylate, hydroxyethyl acrylate, isobutyl acrylate, and 2-ethylhexyl acrylate, and these and/or other acrylic acid and/or other acrylate esters may be combined, including with other compounds, to form various known acrylic acid-based polymers. Although acrylamide is produced in chemical syntheses by hydration of acrylonitrile, herein a conversion may convert acrylic acid to acrylamide by amidation.

Acrylic acid obtained from 3-HP made by the present invention may be further converted to various chemicals, including polymers, which are also considered downstream products in some embodiments. Acrylic acid esters may be formed from acrylic acid (or directly from 3-HP) such as by condensation esterification reactions with an alcohol, releasing water. This chemistry is described in Monomeric Acrylic Esters, E. H. Riddle, Reinhold, N.Y. (1954), incorporated by reference for its esterification teachings. Among esters that are formed are methyl acrylate, ethyl acrylate, n-butyl acrylate, hydroxypropyl acrylate, hydroxyethyl acrylate, isobutyl acrylate, and 2-ethylhexyl acrylate, and these and/or other acrylic acid and/or other acrylate esters may be combined, including with other compounds, to form various known acrylic acid-based polymers. Although acrylamide is produced in chemical syntheses by hydration of acrylonitrile, herein a conversion may convert acrylic acid to acrylamide by amidation.

Direct esterification of acrylic acid can take place by esterification methods known to the person skilled in the art, by contacting the acrylic acid obtained from 3-HP dehydration with one or more alcohols, such as methanol, ethanol, 1-propanol, 2-propanol, n-butanol, tert-butanol or isobutanol, and heating to a temperature of at least 50, 75, 100, 125, or 150° C. The water formed during esterification may be removed from the reaction mixture, such as by azeotropic distillation through the addition of suitable separation aids, or by another means of separation. Conversions up to 95%, or more, may be realized, as is known in the art.

Several suitable esterification catalysts are commercially available, such as from Dow Chemical (Midland, Mich. US). For example, Amberlyst™ 131Wet Monodisperse gel catalyst confers enhanced hydraulic and reactivity properties and is suitable for fixed bed reactors. Amberlyst™ 39Wet is a macroreticular catalyst suitable particularly for stirred and slurry loop reactors. Amberlyst™ 46 is a macroporous catalyst producing less ether byproducts than conventional catalyst (as described in U.S. Pat. No. 5,426,199 to Rohm and Haas, which patent is incorporated by reference for its teachings of esterification catalyst compositions and selection considerations).

Acrylic acid, and any of its esters, may be further converted into various polymers. Polymerization may proceed by any of heat, light, other radiation of sufficient energy, and free radical generating compounds, such as azo compounds or peroxides, to produce a desired polymer of acrylic acid or acrylic acid esters. As one example, an aqueous acrylic acid solution's temperature raised to a temperature known to start polymerization (in part based on the initial acrylic acid concentration), and the reaction proceeds, the process frequently involving heat removal given the high exothermicity of the reaction. Many other methods of polymerization are known in the art. Some are described in Ulmann's Encyclopedia of Industrial Chemistry, Polyacrylamides and Poly(Acrylic Acids), WileyVCH Verlag GmbH, Wienham (2005), incorporated by reference for its teachings of polymerization reactions.

For example, the free-radical polymerization of acrylic acid takes place by polymerization methods known to the skilled worker and can be carried out either in an emulsion or suspension in aqueous solution or another solvent. Initiators, such as but not limited to organic peroxides, often are added to aid in the polymerization. Among the classes of organic peroxides that may be used as initiators are diacyls, peroxydicarbonates, monoperoxycarbonates, peroxyketals, peroxyesters, dialkyls, and hydroperoxides. Another class of initiators is azo initiators, which may be used for acrylate polyermization as well as co-polymerization with other monomers. U.S. Pat. Nos. 5,470,928; 5,510,307; 6,709,919; and 7,678,869 teach various approaches to polymerization using a number of initiators, including organic peroxides, azo compounds, and other chemical types, and are incorporated by reference for such teachings as applicable to the polymers described herein.

Accordingly, it is further possible for co-monomers, such as crosslinkers, to be present during the polymerization. The free-radical polymerization of the acrylic acid obtained from dehydration of 3-HP, as produced herein, in at least partly neutralized form and in the presence of crosslinkers is practiced in certain embodiments. This polymerization may result in hydrogels which can then be comminuted, ground and, where appropriate, surface-modified, by known techniques.

An important commercial use of polyacrylic acid is for superabsorbent polymers. This specification hereby incorporates by reference Modern Superabsorbent Polymer Technology, Buchholz and Graham (Editors), Wiley-VCH, 1997, in its entirety for its teachings regarding superabsorbent polymers components, manufacture, properties and uses. Superabsorbent polymers are primarily used as absorbents for water and aqueous solutions for diapers, adult incontinence products, feminine hygiene products, and similar consumer products. In such consumer products, superabsorbent materials can replace traditional absorbent materials such as cloth, cotton, paper wadding, and cellulose fiber. Superabsorbent polymers absorb, and retain under a slight mechanical pressure, up to 25 times or their weight in liquid. The swollen gel holds the liquid in a solid, rubbery state and prevents the liquid from leaking. Superabsorbent polymer particles can be surface-modified to produce a shell structure with the shell being more highly crosslinked. This technique improves the balance of absorption, absorption under load, and resistance to gel-blocking. It is recognized that superabsorbent polymers have uses in fields other than consumer products, including agriculture, horticulture, and medicine.

Superabsorbent polymers are prepared from acrylic acid (such as acrylic acid derived from 3-HP provided herein) and a crosslinker, by solution or suspension polymerization. Exemplary methods include U.S. Pat. Nos. 5,145,906; 5,350,799; 5,342,899; 4,857,610; 4,985,518; 4,708,997; 5,180,798; 4,666,983; 4,734,478; and 5,331,059, each incorporated by reference for their teachings relating to superabsorbent polymers.

Among consumer products, a diaper, a feminine hygiene product, and an adult incontinence product are made with superabsorbent polymer that itself is made substantially from acrylic acid converted from 3-HP made in accordance with the present invention.

Diapers and other personal hygiene products may be produced that incorporate superabsorbent polymer made from acrylic acid made from 3-HP which is bio-produced by the teachings of the present application. The following provides general guidance for making a diaper that incorporates such superabsorbent polymer. The superabsorbent polymer first is prepared into an absorbent pad that may be vacuum formed, and in which other materials, such as a fibrous material (e.g., wood pulp) are added. The absorbent pad then is assembled with sheet(s) of fabric, generally a nonwoven fabric (e.g., made from one or more of nylon, polyester, polyethylene, and polypropylene plastics) to form diapers.

More particularly, in one non-limiting process, above a conveyer belt multiple pressurized nozzles spray superabsorbent polymer particles (such as about 400 micron size or larger), fibrous material, and/or a combination of these onto the conveyer belt at designated spaces/intervals. The conveyor belt is perforated and under vacuum from below, so that the sprayed on materials are pulled toward the belt surface to form a flat pad. In various embodiments, fibrous material is applied first on the belt, followed by a mixture of fibrous material and the superabsorbent polymer particles, followed by fibrous material, so that the superabsorbent polymer is concentrated in the middle of the pad. A leveling roller may be used toward the end of the belt path to yield pads of uniform thickness. Each pad thereafter may be further processed, such as to cut it to a proper shape for the diaper, or the pad may be in the form of a long roll sufficient for multiple diapers. Thereafter, the pad is sandwiched between a top sheet and a bottom sheet of fabric (one generally being liquid pervious, the other liquid impervious), such as on a conveyor belt, and these are attached together such as by gluing, heating or ultrasonic welding, and cut into diaper-sized units (if not previously so cut). Additional features may be provided, such as elastic components, strips of tape, etc., for fit and ease of wearing by a person.

The ratio of the fibrous material to polymer particles is known to effect performance characteristics. In some embodiments, this ratio is between 75:25 and 90:10 (see U.S. Pat. No. 4,685,915, incorporated by reference for its teachings of diaper manufacture). Other disposable absorbent articles may be constructed in a similar fashion, such as for adult incontinence, feminine hygiene (sanitary napkins), tampons, etc. (see, for example, U.S. Pat. Nos. 5,009,653, 5,558,656, and 5,827,255 incorporated by reference for their teachings of sanitary napkin manufacture).

Low molecular-weight polyacrylic acid has uses for water treatment, flocculants, and thickeners for various applications including cosmetics and pharmaceutical preparations. For these applications, the polymer may be uncrosslinked or lightly crosslinked, depending on the specific application. The molecular weights are typically from about 200 to about 1,000,000 g/mol. Preparation of these low molecular-weight polyacrylic acid polymers is described in U.S. Pat. Nos. 3,904,685; 4,301,266; 2,798,053; and 5,093,472, each of which is incorporated by reference for its teachings relating to methods to produce these polymers.

Acrylic acid may be co-polymerized with one or more other monomers selected from acrylamide, 2-acrylamido-2-methylpropanesulfonic acid, N,N-dimethylacrylamide, N-isopropylacrylamide, methacrylic acid, and methacrylamide, to name a few. The relative reactivities of the monomers affect the microstructure and thus the physical properties of the polymer. Co-monomers may be derived from 3-HP, or otherwise provided, to produce co-polymers. Ulmann's Encyclopedia of Industrial Chemistry, Polyacrylamides and Poly(Acrylic Acids), WileyVCH Verlag GmbH, Wienham (2005), is incorporated by reference herein for its teachings of polymer and co-polymer processing.

Acrylic acid can in principle be copolymerized with almost any free-radically polymerizable monomers including styrene, butadiene, acrylonitrile, acrylic esters, maleic acid, maleic anhydride, vinyl chloride, acrylamide, itaconic acid, and so on. End-use applications typically dictate the co-polymer composition, which influences properties. Acrylic acid also may have a number of optional substitutions on it, and after such substitutions be used as a monomer for polymerization, or co-polymerization reactions. As a general rule, acrylic acid (or one of its co-polymerization monomers) may be substituted by any substituent that does not interfere with the polymerization process, such as alkyl, alkoxy, aryl, heteroaryl, benzyl, vinyl, allyl, hydroxy, epoxy, amide, ethers, esters, ketones, maleimides, succinimides, sulfoxides, glycidyl and silyl (see U.S. Pat. No. 7,678,869, incorporated by reference above, for further discussion). The following paragraphs provide a few non-limiting examples of copolymerization applications.

Paints that comprise polymers and copolymers of acrylic acid and its esters are in wide use as industrial and consumer products. Aspects of the technology for making such paints can be found in U.S. Pat. Nos. 3,687,885 and 3,891,591, incorporated by reference for its teachings of such paint manufacture. Generally, acrylic acid and its esters may form homopolymers or copolymers among themselves or with other monomers, such as amides, methacrylates, acrylonitrile, vinyl, styrene and butadiene. A desired mixture of homopolymers and/or copolymers, referred to in the paint industry as 'vehicle' (or 'binder') are added to an aqueous solution and agitated sufficiently to form an aqueous dispersion that includes sub-micrometer sized polymer particles. The paint cures by coalescence of these 'vehicle' particles as the water and any other solvent evaporate. Other additives to the aqueous dispersion may include pigment, filler (e.g., calcium carbonate, aluminum silicate), solvent (e.g., acetone, benzol, alcohols, etc., although these are not found in certain no VOC paints), thickener, and additional additives depending on the conditions, applications, intended surfaces, etc. In many paints, the weight percent of the vehicle portion may range from about nine to about 26 percent, but for other paints the weight percent may vary beyond this range.

Acrylic-based polymers are used for many coatings in addition to paints. For example, for paper coating latexes, acrylic acid is used from 0.1-5.0%, along with styrene and butadiene, to enhance binding to the paper and modify rheology, freeze-thaw stability and shear stability. In this context, U.S. Pat. Nos. 3,875,101 and 3,872,037 are incorporated by reference for their teachings regarding such latexes. Acrylate-based polymers also are used in many inks, particularly UV curable printing inks. For water treatment, acrylamide and/or hydroxy ethyl acrylate are commonly co-polymerized with acrylic acid to produce low molecular-weight linear polymers. In this context, U.S. Pat. Nos. 4,431,547 and 4,029,577 are incorporated by reference for their teachings of such polymers. Co-polymers of acrylic acid with maleic acid or itaconic acid are also produced for water-treatment applications, as described in U.S. Pat. No. 5,135,677, incorporated by reference for that teaching Sodium acrylate (the sodium salt of glacial acrylic acid) can be co-polymerized with acrylamide (which may be derived from acrylic acid via amidation chemistry) to make an anionic co-polymer that is used as a flocculant in water treatment.

For thickening agents, a variety of co-monomers can be used, such as described in U.S. Pat. Nos. 4,268,641 and 3,915,921, incorporated by reference for description of these co-monomers. U.S. Pat. No. 5,135,677 describes a number of co-monomers that can be used with acrylic acid to produce water-soluble polymers, and is incorporated by reference for such description.

Also as noted, some conversions to downstream products may be made enzymatically. For example, 3-HP may be converted to 3-HP-CoA, which then may be converted into polymerized 3-HP with an enzyme having polyhydroxyacid synthase activity (EC 2.3.1.-). Also, 1,3-propanediol can be made using polypeptides having oxidoreductase activity or reductase activity (e.g., enzymes in the EC 1.1.1.—class of enzymes). Alternatively, when creating 1,3-propanediol from 3HP, a combination of (1) a polypeptide having aldehyde dehydrogenase activity (e.g., an enzyme from the 1.1.1.34 class) and (2) a polypeptide having alcohol dehydrogenase activity (e.g., an enzyme from the 1.1.1.32 class) can be used. Polypeptides having lipase activity may be used to form esters. Enzymatic reactions such as these may be conducted in vitro, such as using cell-free extracts, or in vivo.

Thus, various embodiments of the present invention, such as methods of making a chemical, include conversion steps to any such noted downstream products of microbially produced 3-HP, including but not limited to those chemicals described herein and in the incorporated references (the latter for jurisdictions allowing this). For example, one embodiment is making 3-HP molecules by the teachings herein and further converting the 3-HP molecules to polymerized-3-HP (poly-3-HP) or acrylic acid, and such as from acrylic acid then producing from the 3-HP molecules any one of polyacrylic acid (polymerized acrylic acid, in various forms), methyl acrylate, acrylamide, acrylonitrile, propiolactone, ethyl 3-HP, malonic acid, 1,3-propanediol, ethyl acrylate, n-butyl acrylate, hydroxypropyl acrylate, hydroxyethyl acrylate, isobutyl acrylate, 2-ethylhexyl acrylate, and acrylic acid or an acrylic acid ester to which an alkyl or aryl addition is made, and/or to which halogens, aromatic amines or amides, and aromatic hydrocarbons are added.

Also as noted, some conversions to downstream products may be made enzymatically. For example, 3-HP may be converted to 3-HP-CoA, which then may be converted into polymerized 3-HP with an enzyme having polyhydroxyacid synthase activity (EC 2.3.1.-). Also, 1,3-propanediol can be made using polypeptides having oxidoreductase activity or reductase activity (e.g., enzymes in the EC 1.1.1.—class of enzymes). Alternatively, when creating 1,3-propanediol from 3HP, a combination of (1) a polypeptide having aldehyde dehydrogenase activity (e.g., an enzyme from the 1.1.1.34 class) and (2) a polypeptide having alcohol dehydrogenase activity (e.g., an enzyme from the 1.1.1.32 class) can be used. Polypeptides having lipase activity may be used to form esters. Enzymatic reactions such as these may be conducted in vitro, such as using cell-free extracts, or in vivo.

Thus, various embodiments of the present invention, such as methods of making a chemical, include conversion steps to any such noted downstream products of microbially produced 3-HP, including but not limited to those chemicals described herein and in the incorporated references (the latter for jurisdictions allowing this). For example, one embodiment is making 3-HP molecules by the teachings herein and further converting the 3-HP molecules to polymerized-3-HP (poly-3-HP) or acrylic acid, and such as from acrylic acid then producing from the 3-HP molecules any one of polyacrylic acid (polymerized acrylic acid, in various forms), methyl acrylate, acrylamide, acrylonitrile, propiolactone, ethyl 3-HP, malonic acid, 1,3-propanediol, ethyl acrylate, n-butyl acrylate, hydroxypropyl acrylate, hydroxyethyl acrylate, isobutyl acrylate, 2-ethylhexyl acrylate, and acrylic acid or an acrylic acid ester to which an alkyl or aryl addition is made, and/or to which halogens, aromatic amines or amides, and aromatic hydrocarbons are added.

Reactions that form downstream compounds such as acrylates or acrylamides can be conducted in conjunction with use of suitable stabilizing agents or inhibiting agents reducing likelihood of polymer formation. See, for example, U.S. Patent Publication No. 2007/0219390 A1. Stabilizing agents and/or inhibiting agents include, but are not limited to, e.g., phenolic compounds (e.g., dimethoxyphenol (DMP) or alkylated phenolic compounds such as di-tert-butyl phenol), quinones (e.g., t-butyl hydroquinone or the monomethyl ether of hydroquinone (MEHQ)), and/or metallic copper or copper salts (e.g., copper sulfate, copper chloride, or copper acetate) Inhibitors and/or stabilizers can be used individually or in combinations as will be known by those of skill in the art. Also, in various embodiments, the one or more downstream compounds is/are recovered at a molar yield of up to about 100 percent, or a molar yield in the range from about 70 percent to about 90 percent, or a molar yield in the range from about 80 percent to about 100 percent, or a molar yield in the range from about 90 percent to about 100 percent. Such yields may be the result of single-pass (batch or continuous) or iterative separation and purification steps in a particular process.

Acrylic acid and other downstream products are useful as commodities in manufacturing, such as in the manufacture of consumer goods, including diapers, textiles, carpets, paint, adhesives, and acrylic glass.

XII. Production of Chemical Products Other than 3-HP

Disclosures relating to 3-HP are not meant to be limiting, and it is appreciated that other chemical products may be produced from malonyl-CoA by using the present invention in microorganism host cells that comprise production pathways to such chemical products. The various teaching and combinations of genetic modifications disclosed herein may be, as appropriate, applied to the microorganisms, methods and systems that make 3-HP.

In various embodiments a microorganism cell comprises a metabolic pathway from malonyl-CoA to a selected chemical product, such as 3-HP as particularly described herein, and means for modulating conversion of malonyl-CoA to fatty acyl-ACP molecules (which thereafter may be converted to fatty acids) also are provided. Then, when the means for modulating modulate to decrease such conversion, a proportionally greater number of malonyl-CoA molecules are 1) produced and/or 2) converted via the metabolic pathway from malonyl-CoA to the selected chemical product.

A metabolic pathway from malonyl-CoA to 3-HP is disclosed herein and is not meant to be limiting. Other pathways to 3-HP are known in the art and may be utilized to produce 3-HP, including in combination with any combination of tolerance genetic modifications, as described herein. As shown in an example herein, addition of such genetic modifications related to the 3HPTGC unexpectedly increase specific productivity at 3-HP levels below toxic levels. Any production pathway that produces 3-HP may be combined with genetic modifications of the 3-HPTGC and achieve the specific and/or volumetric productivity metrics disclosed herein.

As to other metabolic pathways for chemical products other than 3-HP, various metabolic pathways for chemical products produced from malonyl-CoA are known to exist in particular organisms (E.g., see <<www.metacyc.org>>), and genetic recombination techniques may be used to provide into a selected microorganism cell the polynucleotides that encode various polynucleotides that catalyze conversions along a respective metabolic pathway. Particular methods of genetic recombination are disclosed herein, and general references teaching such methods also are known to those skilled in the art and also referred to herein, so that one skilled in the art of genetic engineering reasonably may construct such microorganism cell based on these teachings. Alternatively a wild-type microorganism cell comprising such metabolic pathway may be utilized as a starting cell for use in the present invention, such as for genetic modification and/or the methods and systems disclosed and claimed herein.

XIII. Disclosed Embodiments are Non-Limiting

While various embodiments of the present invention have been shown and described herein, it is emphasized that such embodiments are provided by way of example only. Numerous variations, changes and substitutions may be made without departing from the invention herein in its various embodiments. Specifically, and for whatever reason, for any grouping of compounds, nucleic acid sequences, polypeptides including specific proteins including functional enzymes, metabolic pathway enzymes or intermediates, elements, or other compositions, or concentrations stated or otherwise presented herein in a list, table, or other grouping (such as metabolic pathway enzymes shown in a figure), unless clearly stated otherwise, it is intended that each such grouping provides the basis for and serves to identify various subset embodiments, the subset embodiments in their broadest scope comprising every subset of such grouping by exclusion of one or more members (or subsets) of the respective stated grouping. Moreover, when any range is described herein, unless clearly stated otherwise, that range includes all values therein and all sub-ranges therein.

Also, and more generally, in accordance with disclosures, discussions, examples and embodiments herein, there may be employed conventional molecular biology, cellular biology, microbiology, and recombinant DNA techniques within the skill of the art. Such techniques are explained fully in the literature. (See, e.g., Sambrook and Russell, "Molecular Cloning: A Laboratory Manual," Third Edition 2001 (volumes 1-3), Cold Spring Harbor Laboratory Press, Cold Spring Harbor, N.Y.; Animal Cell Culture, R. I. Freshney, ed., 1986.) These published resources are incorporated by reference herein for their respective teachings of standard laboratory methods found therein. Such incorporation, at a minimum, is for the specific teaching and/or other purpose that may be noted when citing the reference herein. If a specific teaching and/or other purpose is not so noted, then the published resource is specifically incorporated for the teaching(s) indicated by one or more of the title, abstract, and/or summary of the reference. If no such specifically identified teaching and/or other purpose may be so relevant, then the published resource is incorporated in order to more fully describe the state of the art to which the present invention pertains, and/or to provide such teachings as are generally known to those skilled in the art, as may be applicable. However, it is specifically stated that a citation of a published resource herein shall not be construed as an admission that such is prior art to the present invention. Also, in the event that one or more of the incorporated published resources differs from or contradicts this application, including but not limited to defined terms, term usage, described techniques, or the like, this application controls. Subject matter in the Examples is incorporated into this section to the extent not already present.

EXAMPLES

The examples herein provide some examples, not meant to be limiting, of combinations of genetic modifications and supplement additions. The following examples include both actual examples and prophetic examples.

Unless indicated otherwise, temperature is in degrees Celsius and pressure is at or near atmospheric pressure at approximately 5,340 feet (1,628 meters) above sea level. It is noted that work done at external analytical and synthetic facilities is not conducted at or near atmospheric pressure at approximately 5,340 feet (1,628 meters) above sea level. Examples 11A and 11C were conducted at a contract laboratory, not at the indicated elevation. All reagents, unless otherwise indicated, are obtained commercially. Species and other phylogenic identifications are according to the classification known to a person skilled in the art of microbiology.

The names and city addresses of major suppliers are provided herein. In addition, as to Qiagen products, the DNeasy® Blood and Tissue Kit, Cat. No. 69506, is used in the methods for genomic DNA preparation; the QIAprep® Spin ("mini prep"), Cat. No. 27106, is used for plasmid DNA purification, and the QIAquick® Gel Extraction Kit, Cat. No. 28706, is used for gel extractions as described herein.

Example 1

Construction of Plasmids Expressing Malonyl-CoA Reductase (mcr)

The nucleotide sequence for the malonyl-CoA reductase gene from *Chloroflexus aurantiacus* was codon-optimized for *E. coli* according to a service from DNA2.0 (Menlo Park, Calif. USA), a commercial DNA gene synthesis provider. This gene sequence (SEQ ID NO:803) incorporated an EcoRI restriction site before the start codon and was followed by a HindIII restriction site. In addition, a ribosomal binding site was placed in front of the start codon. This gene construct was synthesized by DNA2.0 and provided in a pJ206 vector backbone (SEQ ID NO:804). Plasmid DNA pJ206 containing the synthesized mcr gene was subjected to enzymatic restriction digestion with the enzymes EcoRI and HindIII obtained from New England BioLabs (Ipswich, Mass. USA) according to manufacturer's instructions. The digestion mixture was separated by agarose gel electrophoresis and the appropriate DNA fragment recovered as described in the Common Methods Section. An *E. coli* cloning strain bearing pKK223-aroH was obtained as a kind gift from the laboratory of Prof. Ryan T. Gill from the University of Colorado at Boulder. Cultures of this strain bearing the plasmid were grown and plasmid DNA prepared as described in the Common Methods Section. Plasmid DNA was digested with the restriction endonucleases EcoRI and HindIII obtained from New England Biolabs (Ipswich, Mass. USA) according to manufacturer's instructions. This digestion served to separate the aroH reading frame from the pKK223 backbone. The digestion mixture was separated by agarose gel electrophoresis, and he agarose gel slice containing the DNA piece corresponding to the backbone of the pKK223 plasmid was recovered as described in the Common Methods Section.

Purified DNA fragments corresponding to the mcr gene and pK223 vector backbone were ligated and the ligation product was transformed and electroporated according to manufacturer's instructions. The sequence of the resulting vector termed pKK223-mcr was confirmed by routine sequencing performed by a commercial provider (SEQ ID NO:003). pKK223-mcr confers resistance to ampicillin and contains the mcr gene of *C. aurantiacus* under control of a $P_{tac}$ promoter inducible in *E. coli* hosts by IPTG.

To express the mcr gene under the regulation of other promoters besides the $P_{tac}$ on pKK223, the synthetic mcr gene was transferred to other plasmids. Plasmid pTrc-$P_{trc}$-mcr was based on pTrcHisA (Invitrogen, Carlsbad, Calif.; Catalog Number V360-20) and the expression of mcr is directed by the $P_t$, IPTG-inducible promoter. The inducer-independent $P_{talA}$ promoter is based on sequences upstream of the *E. coli* talA gene. The nucleotide sequence of this promoter, placed immediately upstream of the initiator ATG codon of the synthetic mcr gene, is listed as SEQ ID NO:805.

The $P_{talA}$:mcr construct was incorporated by PCR into a pSC-B vector (Stratagene Corporation, La Jolla, Calif., USA), which was propagated in an *E. coli* stock, the plasmid DNA purified according to methods described elsewhere herein. The $P_{talA}$:mcr region in pSC-B-$P_{talA}$:mcr was transferred to a plasmid vector, pSMART-HCamp (Lucigen Corporation, Middleton, Wis., catalog number 40041-2, GenBank AF399742) by PCR using vector primers, M13F and M13R. The fragment generated by PCR was cloned into pSMART-HCamp according to the manufacturer's protocol resulting in plasmid pSMART(HC)Amp-$P_{talA}$-mcr (SEQ ID NO:806) in which mcr expression does not require induction with IPTG.

Example 2

Construction of a Plasmid Expressing Transhydrogenase (pntAB)

A fusion of the inducer-independent *E. coli* promoter derived from the tpiA gene ($P_{tpiA}$) and the pyridine nucleotide transhydrogenase genes, pntAB, (SEQ ID NO:779 and SEQ ID NO:781) was created by amplifying the tpiA promoter region and pntAB region from genomic *E. coli* K12 DNA by polymerase chain reactions. For the pntAB genes, the region was amplified using the pntAB forward primer GGGAACCATGGCAATTGGCATACCAAG (SEQ ID NO:807, noting that all primers disclosed herein are artificial sequences) containing a NcoI site that incorporates the initiator Met for the protein sequence of pntA and the pntAB reverse primer GGGTTACAGAGCTTTCAGGATTGCATCC (SEQ ID NO:808). Likewise, the $P_{tpiA}$ region was amplified using the forward primer GGGAACGGCGGGGAAAAACAAACGTT (SEQ ID NO:809) and the reverse primer GGTCCATGGTAATTCTCCACGCTTATAAGC (SEQ ID NO:810) containing a NcoI restriction site. Polymerase chain reaction products were purified using a PCR purification kit from Qiagen Corporation (Valencia, Calif., USA) using the manufacturer's instructions. Following purification, the products were subjected to enzymatic restriction digestion with the enzyme NcoI. Restriction enzymes were obtained from New England BioLabs (Ipswich, Mass. USA), and used according to manufacturer's instructions. The digestion mixtures were separated by agarose gel electrophoresis, and visualized under UV transillumination as described in the Common Methods Section. Agarose gel slices containing the DNA fragment corresponding to the amplified pntAB gene product and the $P_{tpiA}$ product were excised from the gel and the DNA recovered with a gel extraction kit from Qiagen used according to manufacturer's instructions. The recovered products were ligated together with T4 DNA ligase (New England BioLabs, Ipswich, Mass. USA) according to manufacturer's instructions.

Because the ligation reaction can result in several different products, the desired product corresponding to the $P_{tpiA}$ fragment ligated to the pntAB genes was amplified by polymerase chain reaction and isolated by a second gel purification. For this polymerase chain reaction, the forward primer was GGGAACGGCGGGGAAAAACAAACGTT (SEQ ID NO:809), and the reverse primer was GGGTTACAGAGCTTTCAGGATTGCATCC (SEQ ID NO:808), and the ligation mixture was used as template. The digestion mixtures were separated by agarose gel electrophoresis, and visualized under UV transillumination as described the Common Methods Section. Agarose gel slices containing the DNA piece corresponding to the amplified $P_{tpiA}$-pntAB fusion was cut from the gel and the DNA recovered with a standard gel extraction protocol and components from Qiagen according to manufacturer's instructions. This extracted DNA was inserted into a pSC-B vector using the Blunt PCR Cloning kit obtained from Stratagene Corporation (La Jolla, Calif., USA) using the manufacturer's instructions. Colonies were screened by colony polymerase chain reactions. Plasmid DNA from colonies showing inserts of correct size were cultured and miniprepped using a standard miniprep protocol and components from Qiagen according to the manufacturer's instruction. Isolated plasmids were checked by restriction digests and confirmed by sequencing. The sequenced-verified isolated plasmids produced with this procedure were designated pSC-B-$P_{tpiA}$:pntAB.

The $P_{tpiA}$:pntAB region in pSC-B-$P_{tpiA}$:pntAB was transferred to a pBT-3 vector (SEQ ID NO:811) which provides a broad host range origin of replication and a chloramphenicol selection marker. To achieve this construct, a fragment from pBT-3 vector was produced by polymerase chain amplification using the forward primer AACGAATTCAAGCTTGATATC (SEQ ID NO:812), and the reverse primer GAATTCGTTGACGAATTCTCT (SEQ ID NO:813), using pBT-3 as template. The amplified product was subjected to treatment with DpnI to restrict the methylated template DNA, and the mixture was separated by agarose gel electrophoresis, and visualized under UV transillumination as described in the Common Methods Section. The agarose gel slice containing the DNA fragment corresponding to amplified pBT-3 vector product was cut from the gel and the DNA recovered with a standard gel extraction protocol and components from Qiagen according to manufacturer's instructions. The $P_{tpiA}$:pntAB insert in pSC-B-$P_{tpiA}$:pntAB was amplified using a polymerase chain reaction with the forward primer GGAAACAGCTATGACCATGATTAC (SEQ ID NO:814) and the reverse primer TTGTAAAACGACGGCCAGTGAGCGCG (SEQ ID NO:815). Both primers were 5' phosphorylated.

The PCR product was separated by agarose gel electrophoresis, and visualized under UV transillumination as described in the Common Methods Section. Agarose gel slices containing the DNA fragment corresponding to the amplified $P_{tpiA}$:pntAB insert was excised from the gel and the DNA recovered with a standard gel extraction protocol and components from Qiagen according to manufacturer's instructions. This insert DNA was ligated into the pBT-3 vector prepared as described herein with T4 DNA ligase obtained from New England Biolabs (Bedford, Mass., USA), following the manufacturer's instructions. Ligation mixtures were transformed into *E. coli* 10G cells obtained from Lucigen Corp according to the manufacturer's instructions. Colonies were screened by colony polymerase chain reactions. Plasmid DNA from colonies showing inserts of correct size were cultured and purified using a standard miniprep protocol and components from Qiagen according to the manufacturer's instruction. Isolated plasmids were checked by restriction digests and confirmed by sequencing. The sequenced-verified isolated plasmid produced with this procedure was designated pBT-3-$P_{tpiA}$:pntAB (SEQ ID NO:816).

Example 3

Construction of a Plasmid Expressing Acetyl-CoA Carboxylase (accABCD)

A plasmid carrying two operons able to express the components the acetyl-CoA carboxyltransferase complex from *E. coli* was constructed by DNA2.0 (Menlo Park, Calif. USA), a commercial DNA gene synthesis provider. This construct incorporated the DNA sequences of the accA and accD genes under control of an inducer-independent promoter derived from the *E. coli* tpiA gene, and the DNA sequences of. the accB and accC genes under control of an inducer-independent promoter derived from the *E. coli* rpiA genes. Each coding sequence was preceded by a ribosome-binding sequence. The designed operons were provided in a pJ251 vector backbone and was designated pJ251:26385 (SEQ ID NO:817).

The tpiA promoter of the pJ251:26385 plasmid was altered to provide better expression. This modification was incorporated by amplifying the pJ251:26385 plasmid with the forward primer GCGGGGCAGGAGGAAAAACATG (SEQ ID NO:818) and the reverse primer GCTTATAAGC- GAATAAAGGAAGATGGCCGCCCCGCAGGGCAG (SEQ ID NO:819). Each of these primers were synthesized with a 5' phosphorylation modification. The resulting PCR product was separated by agarose gel electrophoresis, and the appropriate DNA fragment recovered as described in the Common Methods Section. The recovered product was self-ligated with T4 DNA ligase obtained from New England BioLabs (Ipswich, Mass. USA) and digested with DpnI according to manufacturer's instructions. Plasmid DNA from colonies showing inserts of correct size were cultured and purified using a standard miniprep protocol and components from Qiagen according to the manufacturer's instruction. Isolated plasmids were checked by restrictions digests and confirmed by sequencing. The sequenced-verified isolated plasmids produced with this procedure were designated pJ251(26385)-P$_{tpiA}$:accAD-P$_A$:accBC (SEQ ID NO:820).

Example 4

Construction of Plasmids Expressing Genes Related to the 3-HP Toleragenic Complex The examples of plasmid construction for plasmids that comprise genes expressing polypeptides exhibiting enzymatic activity of the 3HPTGC are incorporated from WO 2010/011874, published Jan. 28, 2010. Although many single or combination of genetic modifications of the 3HPTGC may be provided in a particular embodiment so as to increase 3-HP tolerance, only a few are provided in the examples. This is not meant to be limiting.

Example 5

Construction of Specific Strains that Produce 3-Hydroxypropionic Acid

According to the respective combinations indicated in the following table, the plasmids described herein were introduced into the respective base strains. All plasmids were introduced at the same time via electroporation using standard methods. Transformed cells were grown on the appropriate media with antibiotic supplementation and colonies were selected based on their appropriate growth on the selective media. The mcr expression plasmid pKK223-mcr was transformed into E. coli DF40 (Hfr, garB10, fhuA22, ompF627, fadL701, relA1, pitA10, spoT1, rrnB-2, pgi-2, mcrB1, creC527) or E. coli JP1111 (Hfr, galE45(GalS), LAM-, fabI392(ts, temperature-sensitive), relA1, spoT1, thi-1) as described in the Common Methods Section. As is known in the art, the strains DF40 and JP1111 are generally available E. coli strains, available from sources including the Yale Coli Genetic Stock Collection (New Haven, Conn. USA). Strains carrying multiple compatible plasmids were constructed from these mcr transformants by preparing cells competent for transformation by electroporation as described in the Common Methods Section and transforming with the additional plasmids. Transformants were subsequently selected for on media containing the appropriate combination of antibiotics.

TABLE 9

Strain names and characteristics

| Strain name | Host | Plasmids |
|---|---|---|
| KX3_0001 | DF40 | pKK223-mcr |
| JX3_0077 | JP1111 | pKK223-mcr |

TABLE 9-continued

Strain names and characteristics

| Strain name | Host | Plasmids |
|---|---|---|
| JX3_0087 | JP1111 | pkk223-mcr + pBT-3-PtpiA:pntAB |
| JX3_0097 | JP1111 | pkk223-mcr + pJ251(26385)PtpiA:accAD-PrpiA:accBC |
| JX3_0098 | JP1111 | pKK223-mcr + pJ251(26385)PtpiA:accAD-PrpiA:accBC + pBT-3-PtpiA:pntAB |

Example 6

Production of 3-hydroxypropionic Acid

3-HP production by KX3_0001 was demonstrated at 100-mL scale in fed-batch (rich) or AM2 (minimal salts) media. Cultures were started from freezer stocks by standard practice (Sambrook and Russell, 2001) into 50 mL of LB media plus 100 μg/mL ampicillin and grown to stationary phase overnight at 37° C. with rotation at 225 rpm. Five ml of this culture were transferred to 100 ml of fed-batch or AM2 media plus 40 g/L glucose, 100 μg/ml ampicillin, 1 mM IPTG in triplicate 250-ml baffled flasks, and incubated at 37° C., 225 rpm. To monitor cell growth and 3-HP production by these cultures, samples (2 ml) were withdrawn at designated time points for optical density measurements at 600 nm ($OD_{600}$, 1 cm pathlength) and pelleted by centrifugation at 12,000 rpm for 5 min and the supernatant collected for analysis of 3-HP production as described under "Analysis of cultures for 3-HP production" in the Common Methods section. Dry cell weight (DCW) is calculated as 0.33 times the measured $OD_{600}$ value, based on baseline DCW to $OD_{600}$ determinations. All data are the average of triplicate cultures. For comparison purposes, the specific productivity is calculated from the averaged data at the 24-h time point and expressed as g 3-HP produced per gDCW. Production of 3-HP by strain KX3_0001 in fed-batch medium is shown in the following table. Under these conditions, the specific productivity after 24 h is 0.0041 g 3-HP per gDCW.

TABLE 10

Production of 3-HP by KX3_0001 in fed-batch medium

| Time (hr) | 3HP (g/L) | $OD_{600}$ |
|---|---|---|
| 0 | 0.002 | 0.118 |
| 3 | 0.002 | 0.665 |
| 4 | 0.005 | 1.44 |
| 6 | 0.008 | 2.75 |
| 8 | 0.009 | 3.35 |
| 24 | 0.008 | 5.87 |

Example 7

Effect on 3-HP Production of Increased Malonyl-CoA Precursor Pools by Inhibition of Fatty Acid Synthesis As described herein, certain chemicals are known to inhibit various enzymes of the fatty acid synthase system, some of which are used as antibiotics given the role of fatty acid synthesis in membrane maintenance and growth, and microorganism growth. Among these inhibitors is cerulenin, which inhibits the KASI β-ketoacyl-ACP synthase (e.g., fabB in *E. coli*). To further evaluate approaches to modulate and shift malonyl-CoA utilization in microorganisms that comprise production pathways to a selected chemical product, here 3-HP, wherein malonyl-CoA is a substrate in that pathway, addition of cerulenin during a culture was evaluated.

Pathways downstream of malonyl-CoA are limited to fatty acid biosynthesis and 3HP production (when a pathway to the latter via malonyl-CoA exists or is provided in a cell). This experiment is designed to determine how to control the use of malonyl-CoA pools in 3HP production strains and further improve the rate of 3HP production. It is hypothesized that by inhibiting fatty acid biosynthesis and regulating malonyl-CoA pools, flux through the pathway will be shifted toward 3HP production. A diagram of the possible carbon flow through malonyl-CoA in current 3HP production pathways is shown in FIG. 9. A representative inhibitor has been selected that both interrupt fatty acid elongation and disrupt a futile cycle that recaptures the malonate moiety back to the acetyl-CoA pool.

Production by strain KX3_0001 in fed-batch medium in the presence of 10 μg/ml cerulenin is shown in Table 11. In the presence of the inhibitor, internal pools of the malonyl-CoA precursor are proposed to increase thus leading to increased production of 3-HP. As may be seen by comparison to the results without cerulenin (Table 5), substantially more 3-HP is produced at every time point, and the specific productivity at 24 h is 0.128 g 3-HP per gDCW, a 31-fold increase relative to the results without cerulenin.

TABLE 11

Production of 3-HP by KX3_0001 in fed-batch medium and the presence of 10 μg/ml cerulenin

| 3HP (g/L) | $OD_{600}$ |
|---|---|
| 0.002 | 0.118 |
| 0.002 | 0.724 |
| 0.020 | 1.59 |
| 0.060 | 2.80 |
| 0.090 | 3.45 |
| 0.200 | 4.73 |

Example 8

Effect on 3-HP Production of Increased Malonyl-CoA Precursor Pools Using Temperature-Sensitive Fatty Acid Synthesis Mutants An alternative approach to increasing internal malonyl-CoA pools is to use genetic mutations rather than chemical inhibitors. While inactivating mutations in the genes encoding fatty acid synthesis functions are usually lethal and thus not obtainable, conditional mutants, such as temperature-sensitive mutants, have been described (de Mendoza, D., and Cronan, J. E., Jr. (1983) Trends Biochem. Sci., 8, 49-52). For example, a temperature-sensitive mutation in the fabI gene, encoding enoyl-ACP reductase, of strain JP1111 (genotype fabI392(ts)) has relatively normal activity at reduced temperature, such as 30 C, and becomes non-permissive, likely through denaturation and inactivation, at elevated temperature, such that when cultured at 37 to 42 C a microorganism only comprising this temperature-sensitive mutant as its enoyl-ACP reductase will produce substantially less fatty acids and phospholipids. This leads to decreased or no growth. However, it was hypothesized that when such mutant is provided in a genetically modified microorganism that also comprises a production pathway, such as to 3-HP, from malonyl-CoA, effective culture methods involving elevating culture temperature can result in increased 3-HP specific productivity.

Production of 3-HP by strain JX3_0077 in fed-batch medium at a constant temperature of 30° C. and by a culture subjected to a temperature shift from 30° C. to 42° C. is shown in Table 12. The temperature shift is designed to inactivate the enoyl-ACP reductase, hence eliminating the accumulation of fatty acid which in turn increases the internal malonyl-CoA pool. Substantially more 3-HP is produced at every time point, and the specific productivity at 24 h by the temperature-shifted culture is 1.15 g 3-HP per gDCW, a greater than 100-fold increase over the specific productivity of 0.011 g 3-HP per gDCW by the culture maintained constantly at 30° C. This increased productivity of 3-HP by the culture in which the enoyl-ACP reductase is inactivated by elevated temperature supports the view that shifting of malonyl-CoA utilization leads to increased 3-HP production.

TABLE 12

Production of 3-HP by JX3_0077 in fed-batch medium

| | Constant 30° C. | | Shifted to 42° C. | |
|---|---|---|---|---|
| Time (hr) | 3HP (g/L) | $OD_{600}$ | 3HP (g/L) | $OD_{600}$ |
| 0 | 0 | 0.065 | 0.0007 | 0.068 |
| 3 | 0.003 | 0.273 | 0.004 | 0.25 |
| 4 | 0.010 | 0.409 | 0.037 | 0.79 |
| 6 | 0.030 | 1.09 | 0.096 | 0.91 |
| 8 | 0.016 | 1.81 | 0.193 | 0.81 |
| 24 | 0.014 | 3.8 | 0.331 | 0.87 |

Table 13 shows the 3-HP production by strain JX3_0087 which carried a plasmid overexpressing the transhydrogenase gene in addition to a plasmid carrying the mcr gene. In the culture maintained at a constant temperature of 30° C., a specific productivity of 0.085 g 3-HP per gDCW in 24 h was attained. This is significantly higher than the specific productivity of JX3_0077 which does not carry the overexpressed transhydrogenase gene (Table 7). The specific productivity of the temperature-shifted culture of JX3_0087 was 1.68 g 3-HP per gDCW, a 20-fold increase over the specific productivity of the culture maintained constantly at 30° C. in which the enoyl-ACP reductase was not inactivated.

TABLE 13

Production of 3-HP by JX3_0087 in fed-batch medium

| | Constant 30° C. | | Shifted to 42° C. | |
|---|---|---|---|---|
| Time (hr) | 3HP (g/L) | $OD_{600}$ | 3HP (g/L) | $OD_{600}$ |
| 0 | 0 | 0.008 | 0 | 0.004 |
| 3 | 0.0007 | 0.008 | 0.0007 | 0.011 |
| 4 | 0 | 0.04 | 0.002 | 0.063 |
| 6 | 0.0007 | 0.05 | 0.009 | 0.193 |
| 8 | 0.003 | 0.157 | 0.050 | 0.257 |
| 24 | 0.003 | 0.107 | 0.455 | 0.820 |

Table 14 shows the 3-HP production by strain JX3_0097 which carried a plasmid overexpressing genes encoding the acetyl-CoA carboxylase complex in addition to a plasmid carrying the mcr gene. In the culture maintained at a constant temperature of 30° C., a specific productivity of 0.0068 g 3-HP per gDCW in 24 h was attained. This specific productivity is similar to that attained by strain JX3_0077 in which acetyl-CoA carboxylase is not overexpressed. The specific productivity of the temperature-shifted culture of JX3_0097 was 0.29 g 3-HP per gDCW, a 42-fold increase over the specific productivity of the culture maintained constantly at 30° C. in which the enoyl-ACP reductase was not inactivated

TABLE 14

Production of 3-HP by JX3_0097 in fed-batch medium

| | Constant 30° C.* | | Shifted to 42° C.* | |
|---|---|---|---|---|
| Time (hr) | 3HP (g/L) | $OD_{600}$ | 3HP (g/L) | $OD_{600}$ |
| 0 | | 0.016 | 0 | 0.014 |
| 4 | 0.004 | 0.3 | 0.004 | 0.31 |
| 5 | | 0.36 | 0.006 | 0.59 |
| 6 | | 0.65 | 0.062 | 1.51 |
| 8 | 0.006 | 1.46 | 0.178 | 1.91 |
| 24 | 0.006 | 2.66 | 0.176 | 1.87 |

Fed-batch medium, a rich medium, may contain components that serve as fatty acid precursors and thus may reduce the demand for malonyl-CoA. Thus the production of 3-HP by the strains derived from JP1111 in AM2, a minimal medium was verified. As shown in Table 15, 3-HP was produced by JX3_0077 in AM2 medium. A specific productivity of 0.024 g 3-HP per gDCW in 24 h was obtained by the culture maintained constantly at 30° C., approximately twice the value obtained in fed-batch medium. The temperature-shifted culture attained a specific productivity of 1.04 g 3-HP per gDCW over 24 h, a 44-fold increase compared to the specific productivity of the culture maintained constantly at 30° C., again indicating that conditional inactivation of the enoyl-ACP reductase increased the internal malonyl-CoA pool and hence increased the 3-HP production, as envisioned by the inventors.

TABLE 15

Production of 3-HP by JX3_0077 in AM2 medium

| | Constant 30° C. | | Shifted to 42° C. | |
|---|---|---|---|---|
| Time (hr) | 3HP (g/L) | $OD_{600}$ | 3HP (g/L) | $OD_{600}$ |
| 0 | 0 | 0.066 | 0 | 0.063 |
| 4 | 0.002 | 0.360 | 0.002 | 0.40 |
| 5 | 0.004 | 0.253 | 0.015 | 0.39 |
| 6 | 0.004 | 0.413 | 0.1 | 0.68 |
| 8 | 0.005 | 0.476 | 0.2 | 0.71 |
| 24 | 0.008 | 1.03 | 0.25 | 0.73 |

Production of 3-HP in AM2 medium by strain JX3_0087, which carried a plasmid overexpressing the transhydrogenase gene in addition to a plasmid carrying the mcr gene, is shown. In the JX3_0087 culture maintained at a constant temperature of 30° C., a specific productivity of 0.018 g 3-HP per gDCW in 24 h was attained. In contrast to results obtained in fed-batch medium, this value is not higher than the specific productivity obtained in AM2 with strain JX3_0077 which does not carry the overexpressed transhydrogenase gene (Table 15). The specific productivity of the temperature-shifted culture of JX3_0087 was 0.50 g 3-HP per gDCW, a 27-fold increase over the specific productivity of the culture maintained constantly at 30° C. in which the enoyl-ACP reductase was not inactivated.

TABLE 16

Production of 3-HP by JX3_0087 in AM2

| | Constant 30° C. | | Shifted to 42° C. | |
|---|---|---|---|---|
| Time (hr) | 3HP (g/L) | $OD_{600}$ | 3HP (g/L) | $OD_{600}$ |
| 0 | 0 | 0.08 | 0 | 0.086 |
| 4 | 0.002 | 0.363 | 0.002 | 0.380 |
| 5 | 0.002 | 0.273 | 0.011 | 0.360 |
| 6 | 0.003 | 0.297 | 0.050 | 0.520 |
| 8 | 0.005 | 0.467 | 0.100 | 0.607 |
| 24 | 0.006 | 1.0 | 0.112 | 0.683 |

Table 17 shows the 3-HP production in AM2 medium by strain JX3_0097 which carried a plasmid overexpressing genes encoding the acetyl-CoA carboxylase complex in addition to a plasmid carrying the mcr gene. In the culture maintained at a constant temperature of 30° C., a specific productivity of 0.021 g 3-HP per gDCW in 24 h was attained. This specific productivity is similar to that attained by strain JX3_0077 in which acetyl-CoA carboxylase is not overexpressed. The specific productivity of the temperature-shifted culture of JX3_0097 was 0.94 g 3-HP per gDCW in 24 h, a 45-fold increase over the specific productivity of the culture maintained constantly at 30° C. in which the enoyl-ACP reductase was not inactivated.

TABLE 17

Production of 3-HP by JX3_0097.0 in AM2

| | Constant 30° C. | | Shifted to 42° C. | |
|---|---|---|---|---|
| Time (hr) | 3HP (g/L) | $OD_{600}$ | 3HP (g/L) | $OD_{600}$ |
| 0 | 0 | 0.085 | 0.001 | 0.085 |
| 4 | 0.002 | 0.500 | 0.003 | 0.483 |
| 5 | 0.003 | 0.287 | 0.015 | 0.473 |
| 6 | 0.005 | 0.417 | 0.073 | 0.510 |
| 8 | 0.005 | 0.520 | 0.198 | 0.590 |
| 24 | 0.013 | 1.91 | 0.192 | 0.620 |

The effect of combining the plasmids expressing mcr (malonyl-CoA reductase), pntAB (transhydrogenase), and accABCD (acetyl-CoA carboxylase complex) in the same organism was tested by constructing strain JX3_0098. The Table above shows the production of 3-HP by this strain in AM2 medium. A specific productivity of 0.54 g 3-HP per gDCW in 24 h was obtained in the culture maintained constantly at 30° C., representing a >20-fold increase over strains carrying mcr alone or mcr with either pntAB or accABCD, but not both. Shifting the temperature to inactivate enoyl-ACP reductase resulted in a specific productivity of 2.01 g 3-HP per gDCW in 24 h, a further 3.8-fold increase. Thus the combination of overexpression of pntAB and of accABCD, plus the inactivation of enoyl-ACP reductase via the temperature-sensitive $fabI^{ts}$ allele, resulted in an approximately 500-fold increase in specific productivity of 3-HP by mcr-bearing cells (specific productivity of 2.01 vs. 0.0041 g 3-HP per gDCW in 24 h).

TABLE 18

Production of 3-HP by JX3_0098.0 in AM2 medium

| | Constant 30° C. | | Shifted to 42° C. | |
|---|---|---|---|---|
| Time (hr) | 3HP (g/L) | OD$_{600}$ | 3HP (g/L) | OD$_{600}$ |
| 0 | 0.007 | 0.117 | 0 | 0.13 |
| 4 | 0.013 | 0.303 | 0.017 | 0.47 |
| 5 | 0.017 | 0.600 | 0.060 | 0.75 |
| 6 | 0.033 | 0.730 | 0.107 | 0.87 |
| 8 | 0.053 | 0.9107 | 0.263 | 0.81 |
| 24 | 0.670 | 3.790 | 0.577 | 0.81 |

Example 9

Sequence of the fabI$^{ts}$ Mutation

The nature of the exact sequence change in the fabI$^{ts}$ allele carried by strains JP1111 was reconfirmed. Confirmation of this change allows targeted mutagenesis to generate alternative strains with different temperature sensitivities and mutants with stabilities intermediate between wild type and the fabI392 temperature-sensitive allele, allowing growth at a constant temperature higher than 30° C. while providing the benefit of increased internal malonyl-CoA pools. To confirm the DNA sequence of this segment of the chromosome of a wild type (BW25113) and the JP1111 mutant E. coli, chromosomal DNA was prepared from these strains. These DNA were used as templates in a PCR reaction with primers:

```
FW043
                        SEQ ID NO: 821
ATGGGTTTTCTTTCCGG

FW047
                        SEQ ID NO: 822
TTATTTCAGTTCGAGTTCG
```

Thermocyler conditions for the PCR were: 95° C., 10 min; 30 cycles of 95° C., 10 s; 47° C. increasing to 58° C., 30 s; 72° C., 1 min; followed by a final incubation at 72° C. for 5 min. The PCR product was separated on an agarose gel and the appropriate sized fragment recovered as described in the Common Methods Section, and sequenced using primers:

```
FW044
                        SEQ ID NO: 823
CTATCCATCGCCTACGGTATC

FW045
                        SEQ ID NO: 824
CGTTGCAATGGCAAAAGC

FW046
                        SEQ ID NO: 825
CGGCGGTTTCAGCATTGC
```

A comparison of the DNA sequence obtained from the fabI392 (SEQ ID NO:769) and wild type strains reveals a single difference between the alleles of C at position 722 of the wild type gene to T (see FIG. 4A), leading to a protein change of Ser at codon 241 to Phe (See FIG. 4B). These changes are identical to those found by Bergler, H., Hogenauer, G., and Turnowsky, F., J. Gen. Microbiol. 138:2093-2100 (1992).

The identification of the affected residue at codon 241 indicates that targeted mutagenesis at this codon, for example to amino acid residues such as Trp, Tyr, His, Ile, or other amino acids other than Ser or Phe, may result in fabI alleles with different properties than the fabI392 originally isolated in JP1111. Targeted mutagenesis at codons near to codon 241 may also be contemplated to obtain the desired fabI mutants with altered properties.

Example 10

Effect on 3-HP Production of Overexpression of Genes from the 3-HP Toleragenic Complex A series of strains were constructed carrying plasmids that express mcr (pTrc-P$_{trc}$-mcr or pSMART(HC)Amp-P$_{talA}$-mcr) alone or with compatible plasmids carrying representative genes from the 3-HP toleragenic complex (pJ61-aroG, pJ61-thrA, pACYC177-cynTS, pJ61-cynTS). Table 19 categorizes the strains and their characteristics.

TABLE 19

Strain name and characteristics of strain carrying plasmids bearing toleragenic complex genes

| Strain name | Host | Plasmids |
|---|---|---|
| JX3_0118 | JP1111 | pTrc-P$_{trc}$-mcr |
| JX3_0110 | JP1111 | pTrc-P$_{trc}$-mcr + pJ61-aroG |
| JX3_0111 | JP1111 | pTrc-P$_{trc}$-mcr + pJ61-thrA |
| JX3_0112 | JP1111 | pTrc-P$_{trc}$-mcr + pACYC177-cynTS |
| JX3_0113 | JP1111 | pTrc-P$_{trc}$-mcr + pJ61-cynTS |
| JX3_0104 | JP1111 | pSMART(HC)Amp-P$_{talA}$-mcr |
| JX3_0114 | JP1111 | pSMART (HC)Amp-P$_{talA}$-mcr + pJ61-aroG |
| JX3_0119 | JP1111 | pSMART (HC)Amp-P$_{talA}$-mcr + p15A empty vector |
| JX3_0115 | JP1111 | pSMART (HC)Amp-P$_{talA}$-mcr + pJ61-thrA |
| JX3_0116 | JP1111 | pSMART (HC)Amp-P$_{talA}$-mcr + pACYC177-cynTS |
| JX3_0117 | JP1111 | pSMART (HC)Amp-P$_{talA}$-mcr + pJ61-cynTS |
| JX3_0119 | JP1111 | pSMART (HC)Amp-P$_{talA}$-mcr + p15A empty vector |

Production of 3-HP by strains carrying pTrc-P$_{trc}$-mcr without and with plasmids carrying genes from the 3-HP toleragenic complex (3HPTGC) is shown in Table 20. 3-HP production was carried out as in Example 6 except cultures were maintained at constant 30° C., and strains were evaluated based on their specific productivity after 24 hr. As shown in Table 20, the specific productivity of strain JX3_0118, which differs from strain JX3_0077 only in the nature of the IPTG-inducible plasmid, was 0.19 g 3-HP/gDCW in 24 h compared to 0.011 g 3-HP per gDCW by JX3_0077. This 17-fold increase in specific productivity by the culture maintained at a constant 30° C. is attributable to increased stability and mcr expression by pTrc-P$_{trc}$-mcr.

Expression of genes from the 3-HP toleragenic complex further increases productivity of 3-HP. Expression of aroG in JX3_0110 resulted in a 2.3-fold increase, expression of thrA in JX3_0111 resulted in a 2.2-fold increase, and expression of cynTS in JX3_0112 resulted in a 10.6-fold increase in specific productivity in 24 hr.

TABLE 20

| Strain | Time (hr) | 3 HP (g/L) | OD$_{600}$ | Specific Productivity (g 3-HP/gDCW) at 24 h |
|---|---|---|---|---|
| JX3_0118 | 4 | 0.01 | 0.21 | |
| | 6 | 0.03 | 0.50 | |
| | 8 | 0.06 | 0.87 | |
| | 24 | 0.19 | 3.1 | 0.19 |
| JX3_0110 | 4 | 0.05 | 0.28 | |
| | 6 | 0.09 | 0.51 | |
| | 8 | 0.15 | 0.70 | |
| | 24 | 0.40 | 2.8 | 0.43 |
| JX3_0111 | 4 | 0.04 | 0.26 | |
| | 6 | 0.08 | 0.51 | |
| | 8 | 0.13 | 0.62 | |
| | 24 | 0.33 | 2.4 | 0.42 |
| JX3_0112 | 4 | 0.04 | 0.26 | |
| | 6 | 0.10 | 0.50 | |
| | 8 | 0.20 | 0.64 | |
| | 24 | 0.60 | 0.90 | 2.02 |
| JX3_0113 | 4 | 0.01 | 0.06 | |
| | 6 | 0.02 | 0.20 | |
| | 8 | 0.02 | 0.24 | |
| | 24 | 0.08 | 2.2 | 0.11 |

Similar results were obtained in strains carrying mcr expressed by pSMART (HC)Amp-P$_{talA}$-mcr and additional plasmids carrying genes from the 3-HP toleragenic complex. 3-HP production was carried out as in Example 6 except cultures were maintained at constant 30° C., and strains were evaluated based on their specific productivity after 24 hr. Strains carrying the mcr expression plasmid alone (JX3_0104), or with an empty control vector (JX3_0119) had specific productivities of 0.062 or 0.068 g 3-HP per gDCW in 24 hr, respectively. Expression of aroG in JX3_0114 resulted in a 2.4-fold increase, expression of thrA in JX3_0115 resulted in a 2.6-fold increase, and expression of cynTS in JX3_0116 or JX3_0117 resulted in a 2.1-fold increase in specific productivity in 24 hr compared to strain JX3_0119. Thus overexpression of representative genes from the 3-HP toleragenic complex significantly increased the specific productivity of 3-HP even at levels of excreted 3-HP much below those at which the tolerance effects of these genes were first identified. This is an unexpected beneficial result.

TABLE 21

Production of 3-HP by strains carrying pSMART (HC)Amp-P$_{talA}$-mcr and plasmids bearing genes from the 3-HP toleragenic complex

| Strain | Time (hr) | 3 HP (g/L) | OD$_{600}$ | Specific Productivity (g 3-HP/gDCW) at 24 h |
|---|---|---|---|---|
| JX3_0104 | 4 | 0.01 | 0.01 | |
| | 6 | 0.01 | 0.30 | |
| | 8 | 0.02 | 0.80 | |
| | 24 | 0.04 | 1.94 | 0.062 |
| JX3_0119 | 4 | 0.01 | 0.11 | |
| | 6 | 0.01 | 0.4 | |
| | 8 | 0.02 | 0.92 | |
| | 24 | 0.04 | 1.79 | 0.68 |
| JX3_0114 | 4 | 0.03 | 0.19 | |
| | 6 | 0.04 | 0.18 | |
| | 8 | 0.05 | 0.2 | |
| | 24 | 0.13 | 2.38 | 0.17 |
| JX3_0115 | 4 | 0.03 | 0.08 | |
| | 6 | 0.03 | 0.25 | |
| | 8 | 0.04 | 0.32 | |
| | 24 | 0.09 | 1.55 | 0.18 |
| JX3_0116 | 4 | 0.03 | 0.13 | |
| | 6 | 0.04 | 0.30 | |
| | 8 | 0.05 | 0.40 | |
| | 24 | 0.10 | 2202 | 0.15 |
| JX3_0117 | 4 | 0.04 | 0.18 | |
| | 6 | 0.05 | 0.31 | |
| | 8 | 0.07 | 0.73 | |
| | 24 | 0.11 | 2.4 | 0.14 |

Example 11

Effect on Volumetric 3-HP Production in 1 L Fermentations, of Increased Malonyl-coA Precursor Pools Using Temperature Sensitive Fatty Acid Synthesis Mutants Four 1 L fed batch fermentation experiments were carried out using the strain JX3_0098. Briefly, seed cultures were started and grown overnight in LB media (Luria Broth) and used to inoculate four 1 L New Brunswick fermentation vessels. The first vessel contained defined AM2 medium at 30° C., IPTG induction was added at 2 mM at an OD$_{600}$ nm of 2, additional glucose feed was initiated when glucose was depleted to between 1-2 g/L. The temperature was shifted 37° C. over 1 hr at target OD of 10. A high glucose feed rate was maintained at >3 g/L/hr until glucose began to accumulate at concentrations greater than 1 g/L at which time feed rate was varied to maintain residual glucose between 1 and 10 g/L. The second vessel contained defined AM2 medium at 30° C., IPTG induction was added at 2 mM at an OD$_{600}$ nm of 2, additional glucose feed was initiated when glucose was depleted to 0 g/L. The temperature was shifted 37° C. over 1 hr at target OD of 10. The glucose feed rate was maintained less than or equal to 3 g/L/hr. The third vessel contained rich medium at 30° C., IPTG induction was added at 2 mM at an OD$_{600}$ nm of 2, additional glucose feed was initiated when glucose was depleted to 1-2 g/L. The temperature was shifted 37° C. over 1 hr at target OD of 10. A high glucose feed rate was maintained at >3 g/L/hr until glucose began to accumulate at concentrations greater than 1 g/L at which time feed rate was varied to maintain residual glucose between 1 and 10 g/L. The fourth vessel contained rich medium at 30° C., IPTG induction was added at 2 mM at an OD$_{600}$ nm of 2, additional glucose feed was initiated when glucose was depleted to 0 g/L. The temperature was shifted 37° C. over 1 hr at target OD of 10. The glucose feed rate was maintained less than or equal to 3 g/L/hr.

Figure 5:
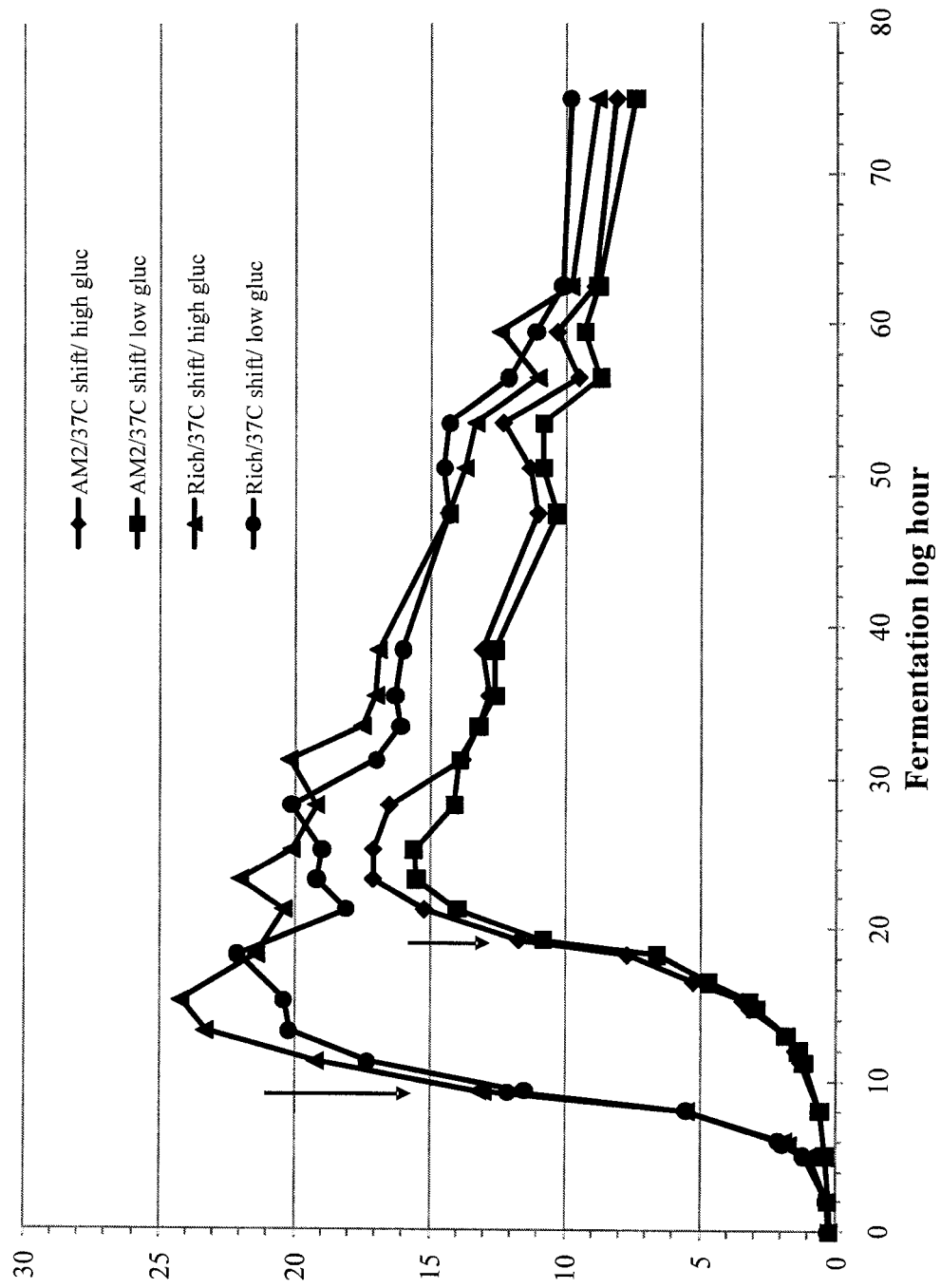
FIGS. 5, 6 and 7 provide data and results from Example 11.
Figure 6:
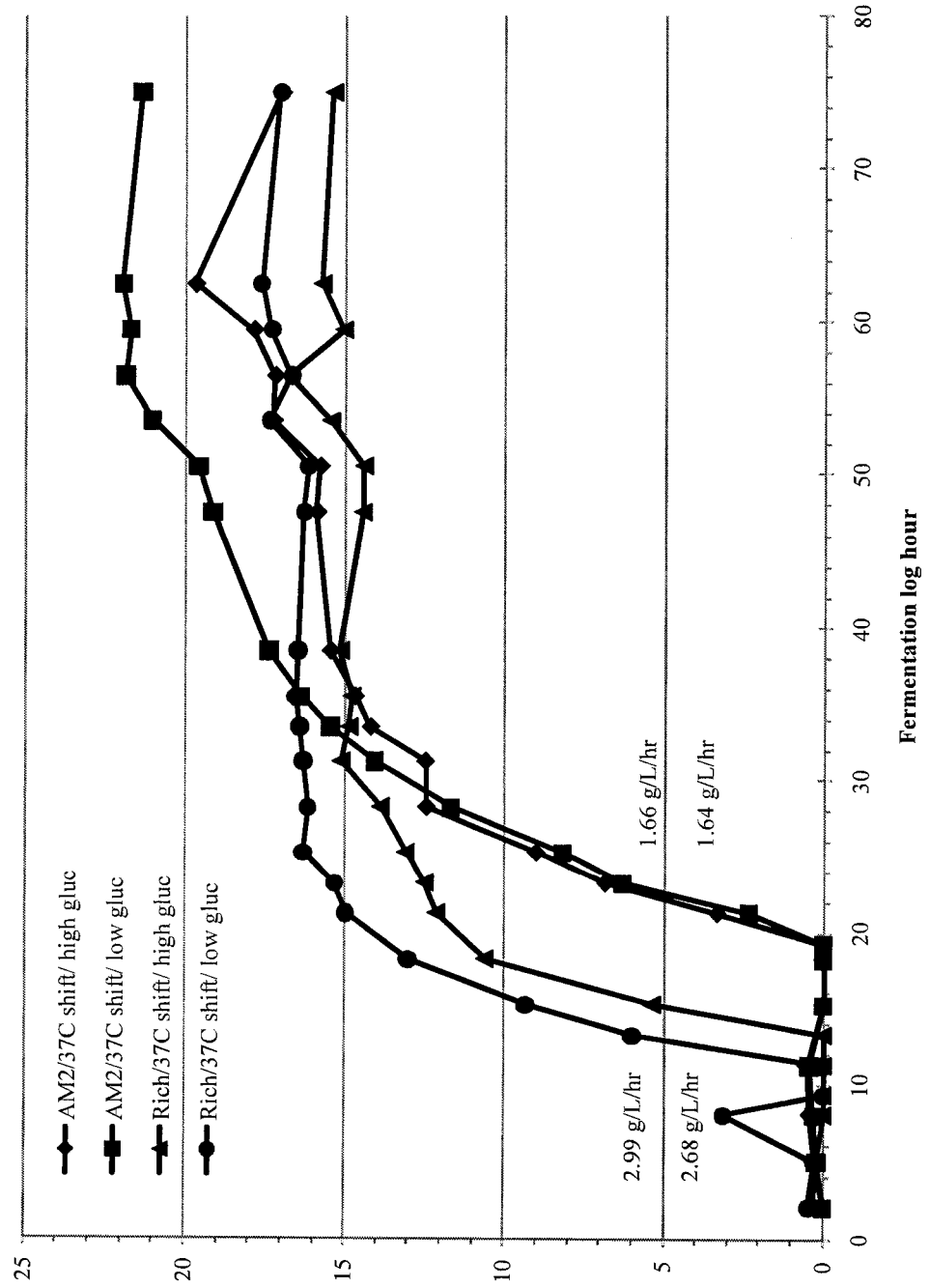
Figure 7:
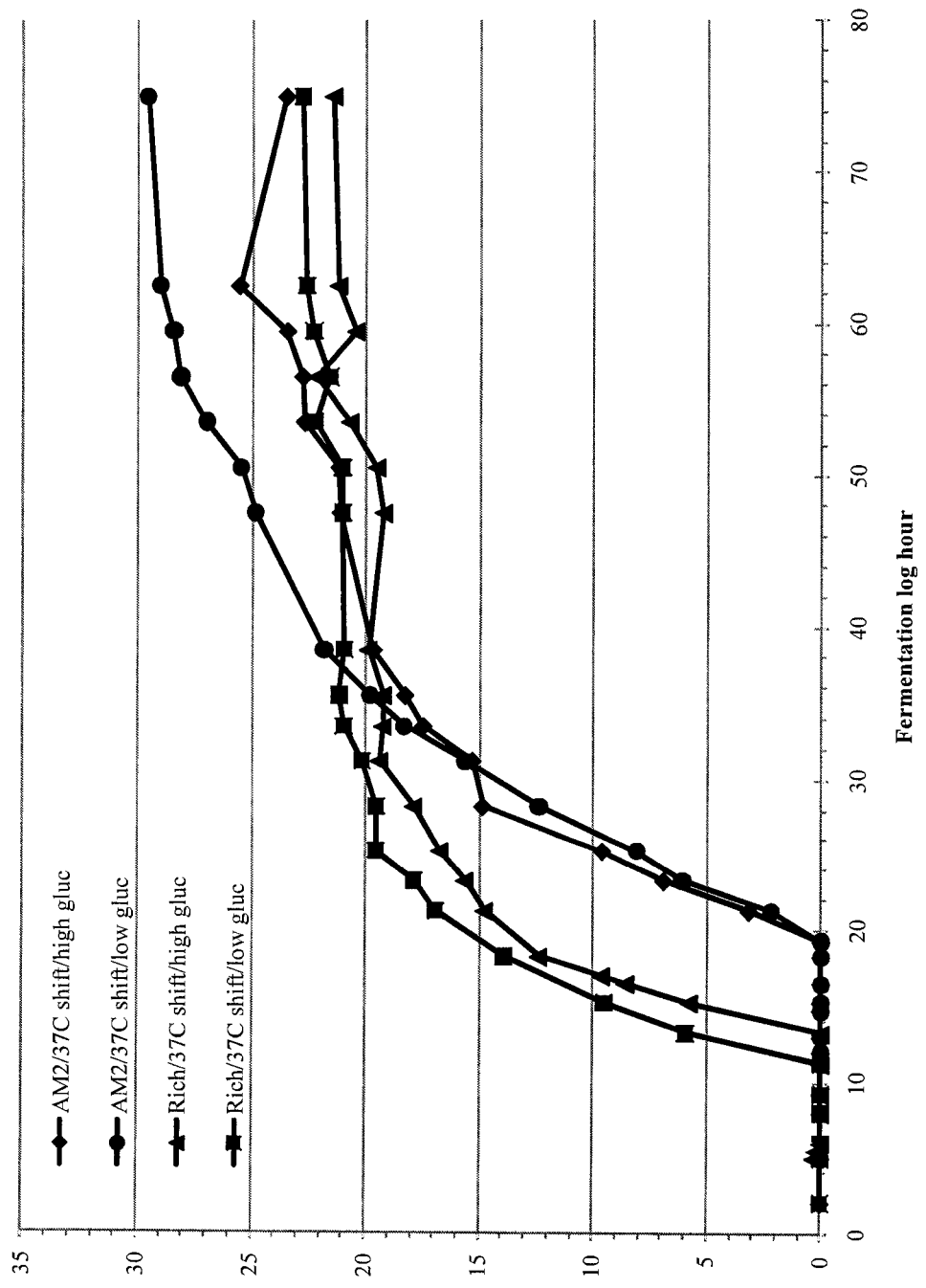

Growth profiles are shown in FIG. 5, arrows indicate the initiation of the temperature shift. All fermentation vessels were maintained at pH=7.4 by the controlled addition of 50% v/v ammonium hydroxide (Fisher Scientific). All vessels were maintained at least 20% dissolved oxygen by aeration with sparged filtered air. Samples were taken for optical density measurements as well as HPLC analysis for 3-HP concentration. (Refer to common methods). Maximum volumetric productivities reached 2.99 g/L/hr. In addition, the figures demonstrate the correlation between the 3-4 hour average biomass concentration and 3-4 hr average volumetric productivity rates in these 4 vessels.

Example 11A

Production of 3-HP in 250 Liter Fermentations

Examples of two fed batch fermentations in a 250 liter volume stainless steel fermentor were carried out using the strain BX3_0240, the genotype of which is described elsewhere herein. A two stage seed process was used to generate inoculum for the 250 L fermentor. In the first stage, one ml of glycerol stock of the strain was inoculated into 100 ml of TB medium (Terrific Broth) in a shake flask and incubated at 30° C. until the $OD_{600}$ was between 3 and 4. In the second stage, 85 ml of the shake flask culture was aseptically transferred to a 14 L New Brunswick fermentor containing 8 L of TB medium and grown at 30° C. and 500 rpm agitation until the $OD_{600}$ was between 5 and 6. The culture from the 14 L fermentor was used to aseptically inoculate the 250 L volume bioreactor containing defined FM5 medium (see Common Methods Section) at 30° C. so that the post-inoculation volume was 155 L.

In the first fermentation, induction was effected by adding IPTG to a final concentration of 2 mM at an $OD_{600}$ of 20. Glucose feed (consisting of a 700 g/L glucose solution) was initiated when the residual glucose in the fermentor was 10-15 g/L. The feed rate was adjusted to maintain the residual glucose between 10 and 15 g/L until about the last 6 hours of the fermentation when the feed rate was reduced so that the residual glucose at harvest was <1 g/L to facilitate 3-HP recovery. Three hours after induction, the temperature was shifted to 37° C. over 1 hour. At the time the temperature shift was initiated, the dissolved oxygen (DO) set point was changed from 20% of air saturation to a point where the DO was maintained between 2-4% of air saturation. The fermentation broth was harvested 48 hours after inoculation. The final broth volume was 169.5 liters.

The second fermentation was run identically to the first example fermentation described above except for the following differences: induction with IPTG was effected at an $OD_{600}$ of 15, the residual glucose (after the glucose feed was started) ranged between 3-30 g/L, and the fermentation broth was harvested at 38.5 hours after inoculation so that the final residual glucose concentration was 25 g/L. The final broth volume was 167 liters.

Each fermentation broth was maintained at a pH of approximately 7.4 by the controlled addition of anhydrous ammonia gas. Dissolved oxygen was maintained at the desired levels by aeration with sparged, sterile-filtered air. Samples were taken for optical density measurements as well as HPLC analysis for 3-HP concentration. In the first fermentation, the maximum biomass concentration was 12.0 g dry cell weight/L and the biomass concentration at harvest was 11.4 g dry cell weight/L. The maximum 3-HP titer in this fermentation was 20.7 g/L. In the second fermentation, the maximum biomass concentration was 10.2 g dry cell weight/L and the biomass concentration at harvest was 9.5 g dry cell weight/L. The maximum 3-HP titer in this fermentation was 20.7 g/L.

Example 11B

Effect of Growth Medium on 3-HP Production in 1 L Fermentations

Eight 1 L fed batch fermentation experiments were carried out using the strain BX3_0240. Seed culture was started from 1 ml of glycerol stock of the strain inoculated into 400 ml of TB medium (Terrific Broth) in a shake flask and incubated at 30° C. until the $OD_{600}$ was between 5 and 6. The shake flask culture was used to aseptically inoculate each 1 L volume bioreactor so that the post-inoculation volume was 653 ml in each vessel.

Fermentors 1 and 2 contained defined FM3 medium. Fermentors 3-5 contained defined FM4 medium. Fermentors 6-8 contained defined FM5 medium. All media formulations are listed in the Common Methods Section. In each fermentor, the initial temperature was 30° C.

Induction was effected by adding IPTG to a final concentration of 2 mM at $OD_{600}$ values of 15-16. Glucose feed (consisting of a 500 g/L glucose solution for FM3 and FM5 media and 500 g/L glucose plus 75 mM $MgSO_4$ for FM4) was initiated when the residual glucose in the fermentor was about 10 g/L. The feed rate was adjusted to maintain the residual glucose>3 g/L (the exception was fermentor 8 in which the residual glucose temporarily reached 0.1 g/L before the feed rate was increased). Three hours after induction, the temperature was shifted to 37° C. over 1 hour. At the time the temperature shift was initiated, the dissolved oxygen (DO) set point was changed from 20% of air saturation to 1% of air saturation. The fermentations were stopped 48 hours after inoculation.

The broth of each fermentor was maintained at a pH of approximately 7.4 by the controlled addition of a pH titrant. The pH titrant for FM3 medium was 5 M NaOH and for FM4 and FM5 it was a 50:50 mixture of concentrated ammonium hydroxide and water. Dissolved oxygen was maintained at the desired levels by sparging with sterile-filtered air. Samples were taken for optical density measurements as well as HPLC analysis for 3-HP concentration. The maximum biomass concentration and the biomass concentration at harvest as well as the maximum 3-HP titer in each fermentor are summarized in the Table 22 below.

TABLE 22

| Fermentor No. | Growth Medium | Maximum Biomass Conc. (g DCW/L) | Biomass Conc. at Harvest (g DCW/L) | Maximum 3HP Titer (g/L) |
|---|---|---|---|---|
| 1 | FM3 | 8.7 | 8.7 | 12.3 |
| 2 | FM3 | 9.6 | 9.5 | 16.7 |
| 3 | FM4 | 10.9 | 10.9 | 20.7 |
| 4 | FM4 | 11.5 | 11.5 | 18.3 |
| 5 | FM4 | 11.3 | 11.3 | 22.1 |
| 6 | FM5 | 11.3 | 11.3 | 35.2 |
| 7 | FM5 | 11.2 | 11.0 | 34.0 |
| 8 | FM5 | 11.6 | 10.6 | 31.2 |

Example 11C

Effect of Batch Phosphate Concentration on 3-HP Production in 1 L Fermentations

Four 1 L fed batch fermentation experiments were carried out using the strain BX3_0240. Seed culture was started from 1 ml of glycerol stock of the strain inoculated into 400 ml of TB medium (Terrific Broth) in a shake flask and incubated at 30° C. until the $OD_{600}$ was between 5 and 7. The shake flask culture was used to aseptically inoculate each 1 L volume bioreactor so that the post-inoculation volume was 653 ml in each vessel.

All fermentors contained defined FM5 growth medium, but each had different initial concentrations of monobasic and dibasic potassium phosphate. The phosphate concentrations in the batch medium in each fermentor are summarized in the Table 23. The FM5 media formulation is listed in the Common Methods Section.

TABLE 23

| Fermentor No. | $K_2HPO_4$ conc. in batch medium (g/L) | $KH_2PO_4$ conc. in batch medium (g/L) |
|---|---|---|
| 1 | 6.1 | 1.92 |
| 2 | 2.63 | 1.38 |
| 3 | 0.87 | 0.14 |
| 4 | 0.043 | 0.070 |

In each fermentor, the initial temperature was 30° C. Induction was effected by adding IPTG to a final concentration of 2 mM when the $OD_{600}$ values were at the following values: fermentor 1, 15.3; fermentor 2, 16.0; fermentor 3, 18.1; fermentor 4, 18.4. Glucose feed (consisting of a 500 g/L glucose solution for FM3 and FM5 media and 500 g/L glucose plus 75 mM $MgSO_4$ for FM4) was initiated when the residual glucose in the fermentor was about 10 g/L. The feed rate was adjusted to maintain the residual glucose>6.5 g/L. Three hours after induction, the temperature was shifted to 37° C. over 1 hour. At the time the temperature shift was initiated, the dissolved oxygen (DO) set point was changed from 20% of air saturation to 1% of air saturation. The fermentations were stopped 48 hours after inoculation.

The broth of each fermentor was maintained at a pH of 7.4 by the controlled addition of a 50:50 mixture of concentrated ammonium hydroxide and water. Dissolved oxygen was maintained at the desired levels by sparging with sterile-filtered air. Samples were taken for optical density measurements as well as HPLC analysis for 3-HP concentration. The maximum biomass concentration and the biomass concentration at harvest as well as the maximum 3-HP titer in each fermentor are summarized in the Table 24 below.

TABLE 24

| Fermentor No. | Maximum Biomass Conc. (g DCW/L) | Biomass Conc. at Harvest (g DCW/L) | Maximum 3 HP Titer (g/L) |
|---|---|---|---|
| 1 | 9.6 | 8.4 | 23.7 |
| 2 | 11.3 | 11.3 | 27.8 |
| 3 | 14.8 | 12.9 | 39.8 |
| 4 | 12.3 | 10.9 | 44.1 |

Example 11D

3-HP Production in 1 L Fermentations

Two 1 L fed batch fermentation experiments were carried out using the strain BX3_0240. Seed culture was started from 1 mL of glycerol stock of the strain inoculated into 100 mL of TB medium (Terrific Broth) in a shake flask and incubated at 30° C. until the $OD_{600}$ was between 5 and 6. The shake flask culture was used to aseptically inoculate (5% volume/volume) each 1 L volume bioreactor so that the post-inoculation volume was 800 mL in each vessel. The fermentors used in this experiment were Das Gip fed-batch pro parallel fermentation system (DASGIP AG, Julich, Germany, model SR07000DLS). The fermentation system included real-time monitoring and control of dissolved oxygen (% DO), pH, temperature, agitation, and feeding. Fermentors 1 and 2 contained defined FM5 medium, made as shown in the Common Methods Section except that Citric Acid was added at 2.0 g/L and $MgSO_4$ was added at 0.40 g/L. In each fermentor, the initial temperature was 30° C. Induction was effected by adding IPTG to a final concentration of 2 mM at $OD_{600}$ values of 17-19, which corresponded to a time post-inoculation of 14.5 hr. Glucose feed (consisting of a 500 g/L glucose solution) was initiated when the residual glucose in the fermentor was about 1 g/L. The feed rate was adjusted to maintain the residual glucose>3 g/L. Three hours after induction, the temperature was shifted to 37° C. over 1 hour. At the time the temperature shift was initiated, the OTR was set to 40 mmol/L-hr by setting airflow and agitation to 1.08 vvm and 1000 rpm respectively. Compressed air at 2 bar was used as the air feed. The broth of each fermentor was maintained at a pH of approximately 7.4 by the controlled addition of a pH titrant. Two hours subsequent to IPTG induction, the pH titrant was changed from 50% $NH_4(OH)$ to 7.4 M NaOH. Samples were taken for optical density measurements as well as HPLC analysis for 3-HP concentration. The maximum biomass concentration and the biomass concentration at harvest as well as the maximum 3-HP titer in each fermentor are summarized in the Table 25 below.

TABLE 25

| Fermentor No. | Maximum Biomass Conc. (g DCW/L) | Biomass Conc. at Harvest (g DCW/L) | Total 3-HP (g) at 69 hrs | Yield of 3-HP At 69 hrs (g3-HP/g glucose) |
|---|---|---|---|---|
| 1 | 10.5 | 8.7 | 49.0 | 0.46 |
| 2 | 10.5 | 8.7 | 47.8 | 0.46 |

The following Table 26 provides a summary of concentrations of metabolic products obtained in the fermentation broth at the indicated time in hours.

TABLE 26

| Replicate | Time (hrs) | 3-HP (g/L) | Pyruvate (g/L) | Succinate (g/L) | Lactate (g/L) |
|---|---|---|---|---|---|
| 1 | 0 | 0 | 0.341 | 0.328 | 0 |
| 1 | 45 | 35.128 | 5.596 | 0 | 0 |
| 1 | 69 | 36.05 | 9.179 | 0 | 0 |
| 2 | 0 | 0 | 0.346 | 0.376 | 0 |
| 2 | 45 | 31.188 | 8.407 | 0 | 0 |
| 2 | 69 | 35.139 | 13.143 | 0 | 0 |

| Fumarate (g/L) | Glutamate (g/L) | Glutamine (g/L) | Glycerol (g/L) | Alanine (g/L) |
|---|---|---|---|---|
| 0.002 | 0.006 | 0 | 0.563 | 0.139 |
| 0.013 | 0.959 | 0 | 0.160 | 0.104 |
| 0.003 | 1.77 | 0 | 0.244 | 0.075 |
| 0.002 | 0.893 | 0.075 | 0.471 | 0.109 |
| 0.004 | 0.796 | 0 | 0.347 | 0.084 |
| 0.011 | 1.23 | 0 | 0.481 | 0.077 |

Example 11E

3-HP Production in 1 L Fermentations

Four 1 L fed batch fermentation experiments were carried out using the strain BX3_0240. Seed culture was started from 1 ml of glycerol stock of the strain inoculated into 100 mL of TB medium (Terrific Broth) in a shake flask and incubated at 30° C. until the $OD_{600}$ was between 5 and 6. The shake flask culture was used to aseptically inoculate (5% volume/volume) each 1 L volume bioreactor so that the post-inoculation volume was 800 ml in each vessel. The fermentors used in this experiment were Das Gip fed-batch pro parallel fermentation system (DASGIP AG, Julich, Germany, model SR07000DLS). The fermentation system included real-time monitoring and control of dissolved oxygen (%

DO), pH, temperature, agitation, and feeding. All fermentors contained defined FM5 medium, made as shown in the Common Methods Section except that Citric Acid was added at 2.0 g/L and MgSO$_4$ was added at 0.40 g/L. In each fermentor, the initial temperature was 30° C. Induction was effected by adding IPTG to a final concentration of 2 mM at OD$_{600}$ values of 15-19, which corresponded to a time post-inoculation of 15.75 hr. Glucose feed (consisting of a 500 g/L glucose solution) was initiated when the residual glucose in the fermentor was about 3 g/L. The feed rate was adjusted to maintain the residual glucose>3 g/L. Three hours after induction, the temperature was shifted to 37° C. over 1 hour. The broth of each fermentor was maintained at a pH of approximately 7.4 by the controlled addition of a pH titrant 50% NH$_4$(OH). At the time the temperature shift was initiated, the OTR was changed for each fermentor by varying the agitation and airflow according to Table 27. Compressed air at (2 bar was used as the air feed) Samples were taken for optical density measurements as well as HPLC analysis for 3-HP concentration. The maximum biomass concentration and the biomass concentration at harvest as well as the maximum 3-HP titer in each fermentor are summarized in the Table 27 below.

TABLE 27

| Fermentor No. | Airflow (vvm) | Agitation during Production (rpm) | Biomass Conc. at Harvest (g DCW/L) | 3HP Titer (g/L) at 37 hrs |
|---|---|---|---|---|
| 1 | 1.08 | 1000 | 8.6 | 14.9 |
| 2 | 1.08 | 800 | 9.0 | 7.9 |
| 3 | 1.08 | 600 | 8.2 | 0.5 |
| 4 | 1.08 | 400 | 5.9 | 0.5 |

Example 11F

3-HP Production in 1.8 L Fermentation

A 1.8 L fed batch fermentation experiment was carried out using the strain BX3_0240. Seed culture was started from 1 ml of glycerol stock of the strain inoculated into 105 ml of TB medium (Terrific Broth) in a shake flask and incubated at 30° C. until the OD600 was between 5 and 7. 90 ml of the shake flask culture was used to aseptically inoculate 1.71 L of FM5 growth medium, except that the phosphate concentrations were 0.33 g/L K2HPO4 and 0.17 g/L KH2PO4 in batch medium. The other ingredients in the FM5 media formulation are as listed in the Common Methods Section. The initial temperature in the fermentor was 30° C. Induction was effected by adding IPTG to a final concentration of 2 mM when the OD600 value was at 15.46. Glucose feed (consisting of a 500 g/L glucose solution) was initiated when the residual glucose in the fermentor was about 10 g/L. The feed rate was adjusted to maintain the residual glucose>6.5 g/L. Three hours after induction, the temperature was shifted to 37° C. over 1 hour. At the time the temperature shift was initiated, the dissolved oxygen (DO) set point was changed from 20% of air saturation to 1% of air saturation. The broth of each fermentor was maintained at a pH of 7.4 by the controlled addition of a 50:50 mixture of concentrated ammonium hydroxide and water. Dissolved oxygen was maintained at the desired levels by sparging with sterile-filtered air. Samples were taken for optical density measurements as well as HPLC analysis for 3-HP concentration. The maximum final biomass concentration was 9.84 g/L, the maximum 3-HP titer was 48.4 g/L with a final yield from glucose of 0.53 g 3-HP/g glucose.

Example 12

Strain Construction for Further Evaluations of 3-HP Production

According to the respective combinations indicated in Table 28 below, the plasmids described herein (e.g., see Example 1) were introduced into the respective strains. All plasmids were introduced at the same time via electroporation using standard methods. Transformed cells were grown on the appropriate media with antibiotic supplementation and colonies were selected based on their appropriate growth on the selective media. As summarized in Table 28, the mcr expression plasmids pTrc-ptrc-mcr or pACYC(kan)-ptalA-mcr were transformed into two strains derived from E. coli BW25113 (F—, Δ(araD-araB)567, ΔlacZ4787(::rrnB-3), lamba-, rph-1, Δ(rhaD-rhaB)568, hsdR514), these strains comprising additional chromosomal modifications introduced using Gene Bridges technology as described in the Common Methods Section. Strain BX_0590 comprises additional deletions of the ldhA, pflB, mgsA, and poxB genes. Strain BX_0591 comprises the additional deletions of Strain BX_0590 and an additional deletion of the ack_pta genes. Transformants were subsequently selected for on media containing the appropriate combination of antibiotics.

TABLE 28

| Strain name | Host | Plasmids |
|---|---|---|
| BX3_0194 | BX_0590 | PTrc-ptrc-mcr |
| BX3_0195 | BX_0591 | PTrc-ptrc-mcr |
| BX3_0206 | BX_0590 | pACYC(kan)-ptalA-mcr |

Example 12A

Construction of Additional Strains for Evaluation

Part 1: Gene Deletions

The homologous recombination method using Red/ET recombination, as described elsewhere herein, was employed for gene deletion in E. coli strains. This method is known to those of ordinary skill in the art and described in U.S. Pat. Nos. 6,355,412 and 6,509,156, issued to Stewart et al. and incorporated by reference herein for its teachings of this method. Material and kits for such method are available from Gene Bridges (Gene Bridges GmbH, Heidelberg (formerly Dresden), Germany, <<www.genebridges.com>>), and the method proceeded by following the manufacturer's instructions. The method replaces the target gene by a selectable marker via homologous recombination performed by the recombinase from λ-phage. The host organism expressing λ-red recombinase is transformed with a linear DNA product coding for a selectable marker flanked by the terminal regions (generally ~50 bp, and alternatively up to about ~300 bp) homologous with the target gene or promoter sequence. The marker is thereafter removed by another recombination step performed by a plasmid vector carrying the FLP-recombinase, or another recombinase, such as Cre.

Specific deletions were constructed by amplification using PCR from the Keio strains carrying particular deletions using primers as specified below. The Keio collection was obtained from Open Biosystems (Huntsville, Ala. USA 35806). Individual clones may be purchased from the Yale Genetic Stock Center (New Haven, Conn. USA 06520). These strains each contain a kanamycin marker in place of the deleted gene. In cases where the desired deletion was not in a Keio strain, for example ackA-pta, the deletion was constructed by the above-noted recombination method using the kanamycin resistance marker to replace the deleted sequence, followed by selection of a kanamycin resistance clone having the deletion. The PCR products were introduced into targeted strains using the above-noted recombination method. Combinations of deletions were generated sequentially to obtain strains as described in the following parts of this example.

TABLE 29

| Plasmid template | Keio Clone Number | Gene Deletion | Forward Primer SEQ ID NO: | Reverse Primer SEQ ID NO: |
|---|---|---|---|---|
| | JW1375 | ldhA | | |
| | JW0886 | pflB | 829 | 842 |
| | JW5129 | mgsA | 830 | 843 |
| | JW0855 | poxB | 831 | 844 |
| | JW2880 | serA | 832 | 845 |
| | JW4364 | arcA | 833 | 846 |
| | JW4356 | trpR | 834 | 847 |
| | JW3561 | aldB | 835 | 848 |
| | JW1412 | aldA | 836 | 849 |
| | JW1293 | puuC | 837 | 850 |
| | JW2755 | relA | 838 | 851 |
| pKD4 | | spoT | 839 | 852 |
| pKD4 | | ackA-pta | 840 | 853 |
| | JW1228 | adhE | 841 | 854 |

Table 31 shows strains having genotypes that comprise deletions according to the methods of this Part.

Part 2: Construction of strains BW_595 and BW_651 having a fabI mutation

The fabI$^{ts}$ mutation (Ser241→Phe) in E. coli strain JP1111 significantly increases the malonyl-CoA concentration when cells are grown at the nonpermissive temperature (37° C.) and thus produces more 3-HP at this temperature. However, JP1111 is not an ideal strain for transitioning into pilot and commercial scale, since it is the product of NTG mutagenesis and thus may harbor unknown mutations, carries mutations in the stringency regulatory factors relA and spoT, and has enhanced conjugation propensity due to the presence of an Hfr factor. Thus the fabI$^{ts}$ mutation was moved into strain BX_591, a strain developed from the well-characterized BW23115 carrying the additional mutations ΔldhA, ΔpflB, ΔmgsA, ΔpoxB, Δpta-ack. These mutations were generated by the sequential application of the gene deletion method described in Part 1 above.

The fabI$^{ts}$ gene with 600 bp of upstream and downstream DNA sequence was isolated from JP1111 genomic DNA by PCR using primers:

```
       FW056:
                              SEQ ID NO: 855
       5'-CCAGTGGGGAGCTACATTCTC;
       and FW057:
                              SEQ ID NO: 856
       5'-CGTCATTCAGATGCTGGCGCATC.
```

The FRT::kan::FRT cassette was then inserted at a SmaI site downstream of the fabI$^{ts}$ to generate plasmid pSMART (HC)amp_fabI$^{ts}$_FRT::kan::FRT. This plasmid was used as template DNA and the region between primers:

```
       FW043:
                              SEQ ID NO: 857
       5'-ATGGGTTTTCTTTCCGG
       and (SEQ ID NO: 856)
       FW057
``` was amplified in a PCR using KOD HS DNA polymerase (Novagen). The reaction was treated with DpnI to fragment the plasmid template and the amplification fragment was gel-purified and recovered using the DNA Clean and Concentrator kit (Zymo Research, Orange, Calif.). Strain BX_591 was transformed with pSIM5 (Datta, S., et al., Gene 379:109-115, 2006) and expression of the lambda red genes carried on this plasmid were induced by incubation at 42° C. for 15 min.

Electrocompetent cells were made by standard methods. These cells were transformed with the amplification fragment bearing the fabI$^{ts}$_FRT::kan::FRT cassette and transformant colonies isolated on LB plates containing 35 μg/ml kanamycin at 30° C. Individual colonies were purified by restreaking, and tested for temperature sensitivity by growth in liquid medium at 30° C. and 42° C. Compared to wildtype parental strain, the strain bearing the fabI$^{ts}$ allele grows poorly at 42° C. but exhibited comparable growth at 30° C. Correct insertion of the FRT::kan::FRT marker was verified by colony PCR, and the fabI$^{ts}$ kan$^R$ strain was designated BX_594.

To allow use of the kan$^R$ marker on plasmids, the marker incorporated in the chromosome adjacent to fabI$^{ts}$ was replaced with a DNA fragment encoding resistance to zeocin. The zeoR gene was amplified by PCR from plasmid pJ402 (DNA 2.0, Menlo Park, Calif.) using primers:

```
HL018:
                              SEQ ID NO: 858
5'-CAGGTTTGCGGCGTCCAGCGGTTATGTAACTACTATTCGGC
GCGACTTACGCCGCTCCCCGCTCGCGATAATGTGGTAGC;
and HL019:
                              SEQ ID NO: 859
5'-AATAAAACCAATGATTTGGCTAATGATCACACAGTC
CCAGGCAGTAAGACCGACGTCATTCTATCATGCCATACCGCGAA.
```

The reaction was treated with DpnI and gel-purified as above. Strain BX_594 was transformed with pKD46 (Datsenko and Wanner, Proc. Natl. Acad. Sci. USA 96: 6640-6645, 2000) and the lambda red genes carried on this plasmid were induced by the addition of L-arabinose to 1 mM for 2 hr. Electrocompetent cells were made by standard methods (e.g, Sambrook and Russell, 2001). These cells were transformed with the zeoR fragment and transformants selected for on LB plates formulated without NaCl and with 25 μg/ml zeocin. Plates were kept in the dark by wrapping in aluminum foil, and incubated at 30° C. A zeocin-resistant, kanamycin-sensitive strain isolated by this method was designated BX_595. Retention of the fabI$^{ts}$ allele was confirmed by growth as above.

Strain BX_651 was constructed by transferring the fabI$^{ts}$-zeoR cassette from BX_595 to strain BW25113 which does not carry mutations in metabolic genes. A DNA fragment carrying this cassette was obtained by PCR using BX_595 chromosomal DNA and primers FW043 (see above) and

FW65:

SEQ ID NO: 860
5'-GAGATAAGCCTGAAATGTCGC.

The PCR product was purified and concentrated using the DNA Clean and Concentrator kit (Zymo Research, Orange, Calif.). Strain BW25113 was transformed with pRedD/ET (Gene Bridges GmBH, Heidelberg, Germany) and the lambda red genes carried on this plasmid were induced by the addition of L-arabinose to 5 mM for 2 hr. Electrocompetent cells were made by standard methods, and transformed with the fabI$^{ts}$-zeoR DNA fragment. Transformants were plated as above on zeocin, and clones bearing the temperature-sensitive allele verified by growth at 30° C. and 42° C. as described above.

Part 3: Promoter Replacement for Selected Genes in Chromosome

The homologous recombination method described elsewhere herein was employed to replace promoters of various genes. As noted, use of Red/ET recombination is known to those of ordinary skill in the art and described in U.S. Pat. Nos. 6,355,412 and 6,509,156, issued to Stewart et al. and incorporated by reference herein for its teachings of this method. Material and kits for such method are available from Gene Bridges (Gene Bridges GmbH, Heidelberg, Germany, <<www.genebridges.com>>), and the method may proceed by following the manufacturer's instructions. The method involves replacement of the target gene (or, in this case, a promoter region) by a selectable marker via homologous recombination performed by the recombinase from λ-phage. The host organism expressing λ-red recombinase is transformed with a linear DNA product coding for a selectable marker flanked by the terminal regions (generally ~50 bp, and alternatively up to about ~300 bp) homologous with the target gene or promoter sequence. The marker can then be removed by another recombination step performed by a plasmid vector carrying the FLP-recombinase, or another recombinase, such as Cre. This method was used according to manufacturer's instructions. Template sequences, each comprising end sequences to achieve the recombination to replace a native promoter for the indicated gene of interest, the desired replacement promoter, and an antibiotic marker sequence, were synthesized by an outside manufacturer (Integrated DNA Technologies, Coralville, Iowa). These sequences are designed to replace the native promoter in front of these genes with a T5 promoter. The T5-aceEF cassette (SEQ ID NO:863) also includes a zeocin resistance cassette flanked by loxP sites. The T5-pntAB (SEQ ID NO:864), T5-udhA (SEQ ID NO:865) and T5-cynTS (SEQ ID NO:866) cassettes each include a blasticidin resistance cassette flanked by loxP sites. Also, T5-cynTS (SEQ ID NO:866) comprises modified loxP sites in accordance with Lambert et al., AEM 73(4) p 1126-1135.

Each cassette first is used as a template for PCR amplification to generate a PCR product using the primers CAGTC-CAGTTACGCTGGAGTC (SEQ ID NO:861), and ACT-GACCATTTAAATCATACCTGACC (SEQ ID NO:862). This PCR product is used for electroporation (using standard methods such as described elsewhere herein) and recombination into the genome following the Red/ET recombination method of Gene Bridges described above. After transformation positive recombinants are selected on media containing zeocin or blasticidin antibiotics. Curing of the resistance marker is accomplished by expression of the Cre-recombinase according to standard methods. Table 31 shows strains having genotypes that comprise replaced promoters. These are shown as "T5" followed by the affected gene(s).

Part 4: Construction of Plasmids

The following table summarizes the construction of plasmids that were used in strains described below. To make the plasmids, a respective gene or gene region of interest was isolated by either PCR amplification and restriction enzyme (RE) digestion or direct restriction enzyme digestion of an appropriate source carrying the gene. The isolated gene was then ligated into the desired vector, transformed into E. coli 10G (Lucigen, Middleton, Wis.) competent cells, screened by restriction mapping and confirmed by DNA sequencing using standard molecular biology procedures (e.g., Sambrook and Russell, 2001).

It is noted that among these plasmids are those that comprise mono-functional malonyl-CoA reductase activity. Particularly, truncated portions of malonyl-CoA reductase from C. aurantiacus were constructed by use of PCR primers adjacent, respectively, to nucleotide bases encoding amino acid residues 366 and 1220, and 496 and 1220, of the codon-optimized malonyl-CoA reductase from pTRC-ptrc-mcr-amp. Also, a malonyl-CoA reductase from Erythrobacter sp. was incorporated into another plasmid. As for other plasmids, these were incorporated into strains and evaluated as described below.

TABLE 30

| Gene(s) or Region Name | Vector and *Supplier | Catalog Number | Cloning Method/Gene(s) Source | Plasmid Name | Plasmid SEQ ID NO: |
| --- | --- | --- | --- | --- | --- |
| Erythrobacter sp MCR | pTRCHisA *A | V360-20 | RE (NcoI/BglII)/ pUC 57-Eb mcr (SEQ ID NO: 905) | pTrc-ptrc-Ebmcr-amp | 871 |
| Truncated C. aurantiacus mcr (366-1220) | pTRCHisA *A | V360-20 | PCR, RE (NcoI/HindIII)/ pTRC-ptrc mcr-amp | pTrc-ptrc-(366-1220)mcr-ptrc-ydfG-kan | 872 |
| Truncated C. aurantiacus mcr (496-1220) | pTRCHisA *A | V360-20 | PCR, RE (NcoI/HindIII)/ pTRC-ptrc mcr-amp | pTrc-ptrc-ydfG-ptrc-(496-1220)mcr-amp | 873 |
| mcr | pTRCHisA *A | V360-20 | PCR, RE (NcoI/HindIII)/ SEQ ID No. 003 | pTrc-ptrc-mcr-amp | 874 |
| mcr | pTRCHisA *A | V360-20 | RE (AhdI, blunted) for Kan insertion/pTRC-ptrc mcr-amp | pTrc-ptrc-mcr-kan | 875 |

TABLE 30-continued

| Gene(s) or Region Name | Vector and *Supplier | Catalog Number | Cloning Method/Gene(s) Source | Plasmid Name | Plasmid SEQ ID NO: |
|---|---|---|---|---|---|
| mcr/cynTS | pTRCHisA *A | V360-20 | RE/(NdeI, blunted: pTRC ptrc-mcr kan), (EcoRV: pSMARTHC ampcynTS) | pTrc-ptrc-mcr-kan-cynTS | 876 |
| accABCD | pJ251 *C | N/A | RE (EcoNI, AseI, blunted) for Cat insertion/SEQ ID No 820 | pJ251-cat-PtpiA-accAD-PrpiA-accBC | 877 |
| pntAB | pACYC184 cat *B | E4152S | RE (NruI, PciI, blunted) self-ligate/pACYC184-cat-PtpiA-accAD-PrpiA-accBC-ptalA-pntAB | pACYC184-cat-PtalA-pntAB | 878 |
| acccABCD/pntAB | pACYC184 cat *B | E4152S | RE/(EcoRV, AvaI, BseB1, blunted: pACYC184), (BamHI, blunted: pJ244-pntAB-accABCD) | pACYC184-cat-PtpiA-accAD-PrpiA-accBC-ptalA-pntAB | 879 |
| accABCD/udhA | pACYC184 cat *B | E4152S | RE (SwaI, ApaI)/ pJ244-pTaI-udhA | pACYC184-cat-PtpiA-accAD-PrpiA-accBC-ptalA-udhA | 880 |
| accABCD/T5-udhA | pACYC184 cat *B | E4152S | RE (SwaI, NdeI)/ pACYC184-cat-PtpiA-accAD-PrpiA-accBC PCR, RE (PmeI, NdeI)/BX_00635 | pACYC184-cat-PtpiA-accAD-PrpiA-accBC-T5-udhA | 881 |
| mcr/serA | pTRCHisA *A | V360-20 | RE (PciI, blunted) for pTpiA serA insertion/SEQ ID No. 0047 | pTrc-ptrc mcr-kan-PtpiA-serA | 882 |
| fabF | pTRCHisA A* | V360-20 | PCR, RE (NcoI/PstI)/ E. coli K12 genome | pTrc-ptrc-fabF-amp | 883 |
| mcr | pACYC177 kan *B | E4151S | PCR (blunt)/ pTRC-ptrc mcr-amp | pACYC177-kan-ptrc-mcr | 884 |
| mcr/accABCD | pACYC177 kan *B | E4151S | RE/(SwaI, XbaI: pACYC 177 kan ptrc-mcr), (PmeI, XbaI: pJ251-cat-PtpiA-accAD-PrpiA-accBC | pACYC177-kan-ptrc-mcr-PtpiA-accAD-PrpiA-accBC | 885 |

*A: Invitrogen, Carlsbad, CA;
*B: New England Biolabs, Ipswich, MA;
*C: DNA 2.0, Menlo Park, CA Part 5: Cloning of pACYC-cat-accABCD-P$_{T5}$-udhA.

The P$_{talA}$ promoter driving expression of udhA in pACYC-cat-accABCD-udhA was replaced with the stronger T5 promoter. The genomic P$_{T5}$-udhA construct from strain BX_00635—was amplified using primer AS1170 (udhA 300 bp upstream). See SEQ ID NO:886 for sequence of udhA). PCR fragments of P$_{T5}$-udhA obtained above were digested with PmeI and NdeI (New England BioLabs, Ipswich, Mass.). Vector pACYC-cat-accABCD-P$_{tal}$-udhA was similarly digested with SwaI and NdeI (New England BioLabs). The two digested DNA fragments were ligated and transformed to create pACYC-cat-accABCD-P$_{T5}$-udhA (SEQ ID NO:887). Plasmid digests were used to confirm the correct sequence. This plasmid is incorporated into strains shown in Table 31.

Part 6: Strain Construction

Using constructs made by the above methods, strains shown in Table 31, given the indicated Strain Names, were produced providing the genotypes. This is not meant to be limiting, and other strains may be made using these methods and following the teachings provided in this application, including providing different genes and gene regions for tolerance, and/or 3-HP production and modifications to modulate the fatty acid synthase system. Further to the latter, such strains may be produced by chromosomal modifications and/or introduction of non-chromosomal introductions, such as plasmids.

As to the latter, according to the respective combinations indicated in Table 38 below, the plasmids described above were introduced into the respective strains. All plasmids were introduced at the same time via electroporation using standard methods. Transformed cells were grown on the appropriate media with antibiotic supplementation and colonies were selected based on their appropriate growth on the selective media.

TABLE 31

| Strain Name | Strain Genotype |
|---|---|
| BW25113 | F-, Δ(araD-araB)567, ΔlacZ4787(::rrnB-3), LAM-, rph-1, Δ(rhaD-rhaB)568, hsdR514 |
| BX_0591 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt |
| BX_0595 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR |
| BX_0619 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB-BSD |
| BX_0634 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF |
| BX_0635 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF, T5-udhA-BSD |
| BX_0636 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-aceEF |
| BX_0637 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-aceEF, T5-udhA-BSD |
| BX_0638 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF, ΔaldB::frt |
| BX_0639 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF, ΔtrpR::kan |
| BX_0651 | F-, Δ(araD-araB)567, ΔlacZ4787(::rrnB-3), LAM-, rph-1, Δ(rhaD-rhaB)568, hsdR514, fabI$^{rs}$ (S241F)-zeoR |
| BX_0652 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF, T5-udhA, ΔarcA::kan |
| BX_0653 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF, T5-udhA, ΔpuuC::kan |
| BX_0654 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabI$^{rs}$ (S241F)-zeoR, T5-pntAB, T5-aceEF, T5-udhA, ΔaldA::kan |

Example 12B

Preparing a Genetically Modified *E. coli* Host Cell Comprising malonyl-CoA-reductase (Mcr) in Combination with Other Genetic Modifications to Increase 3-HP Production Relative to a Control *E. coli* Cell (Prophetic)

Genetic modifications are made to introduce a vector comprising mmsB such as from *Pseudomonas* auruginos, which further is codon-optimized for *E. coli*. Vectors comprising galP and a native or mutated ppc also may be introduced by methods known to those skilled in the art (see, e.g., Sambrook and Russell, Molecular Cloning: A Laboratory Manual, Third Edition 2001 (volumes 1-3), Cold Spring Harbor Laboratory Press, Cold Spring Harbor, N.Y., "Sambrook and Russell, 2001"), additionally recognizing that mutations may be made by a method using the XL1-Red mutator strain, using appropriate materials following a manufacturer's instructions (Stratagene QuikChange Mutagenesis Kit, Stratagene, La Jolla, Calif. USA) and selected for or screened under standard protocols.

Also, genetic modifications are made to reduce or eliminate the enzymatic activities of *E. coli* genes as desired. These genetic modifications are achieved by using the RED/ET homologous recombination method with kits supplied by Gene Bridges (Gene Bridges GmbH, Dresden, Germany, www.genebridges.com) according to manufacturer's instructions.

Also, in some embodiments genetic modifications are made to increase the NADPH cellular pool. Non-limiting examples of some targets for genetic modification are provided herein. These are pgi (in a mutated form), pntAB, overexpressed, gapA:gapN substitution/replacement, and disrupting or modifying a soluble transhydrogenase such as sthA, and genetic modifications of one or more of zwf, gnd, and edd.

The so-genetically modified microorganism of any such engineered embodiment is evaluated and found to exhibit higher productivity of 3-HP compared with a control *E. coli* lacking said genetic modifications. Productivity is measured by standard metrics, such as volumetric productivity (grams of 3-HP/hour) under similar culture conditions.

Example 12C

Mutational Development of Selected Polynucleotides (Prophetic)

A selected gene sequence, such as a nucleic acid sequence that encodes for any of SEQ ID NOs:783-791, is subjected to a mutation development protocol, starting by constructing a mutant library of a native or previously evolved and/or codon-optimized polynucleotide by use of an error-inducing PCR site-directed mutagenesis method.

A polynucleotide exhibiting enzymatic activity of the selected gene (which may be any disclosed herein, e.g., an aminotransferase or mmsB) is cloned into an appropriate expression system for *E. coli*. This sequence may be codon optimized. Cloning of a codon-optimized polynucleotide and its adequate expression will be accomplished via gene synthesis supplied from a commercial supplier using standard techniques. The gene will be synthesized with an eight amino acid C-terminal tag to enable affinity based protein purification. Once obtained using standard methodology, the gene will be cloned into an expression system using standard techniques.

The plasmid containing the above-described polynucleotide will be mutated by standard methods resulting in a large library of mutants (>10⁶). The mutant sequences will be excised from these plasmids and again cloned into an expression vector, generating a final library of greater than 10⁶ clones for subsequent screening. These numbers ensure a greater than 99% probability that the library will contain a mutation in every amino acid encoded by sequence. It is acknowledged that each method of creating a mutational library has its own biases, including transformation into mutator strains of E. coli, error prone PCR, and in addition more site directed muagenesis.

In some embodiments, various methods may be considered and possibly several explored in parallel. One such method is the use of the XL1-Red mutator strain, which is deficient in several repair mechanisms necessary for accurate DNA replication and generates mutations in plasmids at a rate 5,000 times that of the wild-type mutation rate, may be employed using appropriate materials following a manufacturer's instructions (See Stratagene QuikChange Mutagenesis Kit, Stratagene, La Jolla, Calif. USA). This technique or other techniques known to those skilled in the art, may be employed and then a population of such mutants, e.g., in a library, is evaluated, such as by a screening or selection method, to identify clones having a suitable or favorable mutation.

With the successful construction of a mutant library, it will be possible to screen this library for increased activity, such as increased malonyl-CoA reductase activity. The screening process will be designed to screen the entire library of greater than 10⁶ mutants. This is done by screening methods suited to the particular enzymatic reaction.

Example 13

Evaluation of 3-HP Production Using Strains of Example 12

3-HP production by BX3__0194 was demonstrated at 100-mL scale in SM3 (minimal salts) media. Cultures were started from freezer stocks by standard practice (Sambrook and Russell, 2001) into 50 mL of LB media plus 100 µg/mL ampicillin and grown to stationary phase overnight at 37° C. with rotation at 225 rpm. Five ml of this culture were transferred to 100 ml of SM3 media plus 40 g/L glucose, 100 µg/ml ampicillin, and 1 mM IPTG in triplicate 250-ml baffled flasks and incubated at 37° C., 225 rpm. To monitor cell growth and 3-HP production by these cultures, samples (2 ml) were withdrawn at designated time points for optical density measurements at 600 nm ($OD_{600}$, 1 cm pathlength) and pelleted by centrifugation at 12,000 rpm for 5 min and the supernatant collected for analysis of 3-HP production as described under "Analysis of cultures for 3-HP production" in the Common Methods section. Dry cell weight (DCW) is calculated as 0.33 times the measured $OD_{600}$ value, based on baseline DCW to $OD_{600}$ determinations. All data are the average of triplicate cultures. For comparison purposes, the specific productivity is calculated from the averaged data at the 24-h time point and expressed as g 3-HP produced per gDCW. Under these conditions, no 3HP is produced after 24 hours in a culture growing to an $OD_{600}$ that corresponds to approximately 1.0 g DCW. Production of 3-HP by strain BX3__0194 in SM3 medium is shown in Table 32.

TABLE 32

Production of 3-HP by BX3_0194 in SM3 medium

| Time (hr) | 3HP (g/L) | $OD_{600}$ |
|---|---|---|
| 4 | 0 | 1.3 |
| 6 | 0 | 2.3 |
| 8 | 0 | 2.8 |
| 24 | 0 | 3.4 |

Production by strain BX3__0194 in SM3 medium in the presence of 10 µg/ml cerulenin is shown in Table 33. In the presence of cerulenin, an inhibitor of the fatty acid synthase system, internal pools of the malonyl-CoA precursor are proposed to increase thus leading to increased production of 3-HP. As may be seen by comparison to the results without cerulenin (Table 32), substantially more 3-HP is produced at every time point. Under these conditions, the specific productivity after 24 hours is 1.3 g 3HP per gDCW.

TABLE 33

Production of 3-HP by BX3_0194 in SM3 medium and the presence of 10 µg/ml cerulenin

| Time (hr) | 3HP (g/L) | $OD_{600}$ |
|---|---|---|
| 4 | 0.003 | 1.3 |
| 6 | 0.14 | 2.6 |
| 8 | 0.43 | 3.1 |
| 24 | 1.43 | 3.3 |

3-HP production by BX3__0195 was demonstrated at 100-mL scale in SM3 (minimal salts) media. Cultures were started from freezer stocks by standard practice (Sambrook and Russell, 2001) into 50 mL of LB media plus 100 µg/mL ampicillin and grown to stationary phase overnight at 37° C. with rotation at 225 rpm. Five ml of this culture were transferred to 100 ml of SM3 media plus 40 g/L glucose, 100 µg/ml ampicillin, and 1 mM IPTG in triplicate 250-ml baffled flasks and incubated at 37° C., 225 rpm. To monitor cell growth and 3-HP production by these cultures, samples (2 ml) were withdrawn at designated time points for optical density measurements at 600 nm ($OD_{600}$, 1 cm pathlength) and pelleted by centrifugation at 12,000 rpm for 5 min and the supernatant collected for analysis of 3-HP production as described under "Analysis of cultures for 3-HP production" in the Common Methods section. Dry cell weight (DCW) is calculated as 0.33 times the measured $OD_{600}$ value, based on baseline DCW to $OD_{600}$ determinations. All data are the average of triplicate cultures. For comparison purposes, the specific productivity is calculated from the averaged data at the 24-h time point and expressed as g 3-HP produced per gDCW. Under these conditions, no 3HP is produced after 24 hours in a culture growing to and $OD_{600}$ that corresponds to approximately 1.65 g DCW. Production of 3-HP by strain BX3__0195 in SM3 medium is shown in Table 34.

TABLE 34

Production of 3-HP by BX3_0195 in SM3 medium

| Time (hr) | 3HP (g/L) | $OD_{600}$ |
|---|---|---|
| 4 | 0 | 0.92 |
| 6 | 0 | 1.35 |
| 8 | 0 | 2.36 |
| 24 | 0 | 5.00 |

Production by strain BX3_0195 in SM3 medium in the presence of 10 μg/ml cerulenin is shown in Table 35. In the presence of cerulenin, an inhibitor of the fatty acid synthase system, internal pools of the malonyl-CoA precursor are proposed to increase thus leading to increased production of 3-HP. As may be seen by comparison to the results without cerulenin (Table 34), substantially more 3-HP is produced at every time point. Under these conditions, the specific productivity after 24 hours is 0.54 g 3HP per gDCW.

TABLE 35

Production of 3-HP by BX3_0195 in SM3 medium and the presence of 10 μg/ml cerulenin

| Time (hr) | 3HP (g/L) | $OD_{600}$ |
|---|---|---|
| 4 | 0.003 | 0.97 |
| 6 | 0.07 | 1.57 |
| 8 | 0.31 | 2.36 |
| 24 | 1.17 | 6.59 |

3-HP production by BX3_0206 was demonstrated at 100-mL scale in SM3 (minimal salts) media. Cultures were started from freezer stocks by standard practice (Sambrook and Russell, 2001) into 50 mL of LB media plus 35 μg/mL kanamycin and grown to stationary phase overnight at 37° C. with rotation at 225 rpm. Five ml of this culture were transferred to 100 ml of SM3 media plus 40 g/L glucose and 35 μg/ml kanamycin in triplicate 250-ml baffled flasks and incubated at 37° C., 225 rpm. To monitor cell growth and 3-HP production by these cultures, samples (2 ml) were withdrawn at designated time points for optical density measurements at 600 nm ($OD_{600}$, 1 cm pathlength) and pelleted by centrifugation at 12,000 rpm for 5 min and the supernatant collected for analysis of 3-HP production as described under "Analysis of cultures for 3-HP production" in the Common Methods section. Dry cell weight (DCW) is calculated as 0.33 times the measured $OD_{600}$ value, based on baseline DCW to $OD_{600}$ determinations. All data are the average of triplicate cultures. For comparison purposes, the specific productivity is calculated from the averaged data at the 24-h time point and expressed as g 3-HP produced per gDCW. Under these conditions, the specific productivity after 24 hours is 0.05 g 3HP per gDCW. Production of 3-HP by strain BX3_0206 in SM3 medium is shown in Table 36.

TABLE 36

Production of 3-HP by BX3_0206 in SM3 medium

| Time (hr) | 3HP (g/L) | $OD_{600}$ |
|---|---|---|
| 24 | 0.01 | 6.5 |

Production by strain BX3_0206 in SM3 medium in the presence of 10 μg/ml cerulenin is shown in Table 37. In the presence of cerulenin, an inhibitor of the fatty acid synthase system internal pools of the malonyl-CoA precursor are proposed to increase thus leading to increased production of 3-HP. As may be seen by comparison to the results without cerulenin (Table 36), substantially more 3-HP is produced after 24 hours. Under these conditions, the specific productivity after 24 hours is 0.20 g 3HP per gDCW, an approximately 40-fold increase relative to the results without cerulenin.

TABLE 37

Production of 3-HP by BX3_0195 in SM3 medium and the presence of 10 μg/ml cerulenin

| Time (hr) | 3HP (g/L) | $OD_{600}$ |
|---|---|---|
| 24 | 0.43 | 6.4 |

Example 13A

Evaluation of Strains for 3-HP Production

3-HP production in biocatalysts (strains) listed in the following table was demonstrated at 100-mL scale in SM3 (minimal salts) media. SM3 used is described under the Common Methods Section, but was supplemented with 200 mM MOPS. Cultures were started from LB plates containing antibiotics by standard practice (Sambrook and Russell, 2001) into 50 mL of TB media plus the appropriate antibiotic as indicated and grown to stationary phase overnight at 30° C. with rotation at 250 rpm. Five ml of this culture were transferred to 100 ml of SM3 media plus 30 g/L glucose, antibiotic, and 1 mM IPTG (identified as "yes" under the "Induced" column) in triplicate 250-ml baffled flasks and incubated at 30° C., 250 rpm. Flasks were shifted to 37° C., 250 rpm after 4 hours. To monitor cell growth and 3-HP production by these cultures, samples (2 ml) were withdrawn at 24 hours for optical density measurements at 600 nm ($OD_{600}$, 1 cm pathlength) and pelleted by centrifugation at 14000 rpm for 5 min and the supernatant collected for analysis of 3-HP production as described under "Analysis of cultures for 3-HP production" in the Common Methods section. 3-HP titer and standard deviation is expressed as g/L. Dry cell weight (DCW) is calculated as 0.33 times the measured $OD_{600}$ value, based on baseline DCW per $OD_{600}$ determinations. All data are the average of triplicate cultures. For comparison purposes, product to cell ratio is calculated from the averaged data over 24 hours and is expressed as g 3-HP produced per gDCW. The specific productivity is calculated from the cell/product ratio obtained over the 20 hours of production and expressed as g 3-HP produced per gDCW per hour.

TABLE 38

| Strain Name | Strain Host | Plasmids | Induced | Average 24 Hour Titer | Standard Deviation | 20 Hour Specific Productivity | 24 Hour Product/Cell Ratio |
|---|---|---|---|---|---|---|---|
| BX3_0274 | BW25113 | 1) pTrc-ptrc-mcr-kan | yes | <0.001 | 0.000 | <0.001 | <0.001 |
| BX3_0282 | BW25113 | 1) pTrc-ptrc-mcr-kan 2) pJ251-cat-PtpiA-accAD-PrpiA-accBC | yes | <0.001 | 0.000 | <0.001 | <0.001 |
| BX3_0283 | BW25113 | 1) pTrc-ptrc-mcr-kan 2) pACYC184-cat-PtalA-pntAB | yes | <0.001 | 0.000 | <0.001 | <0.001 |

TABLE 38-continued

| Strain Name | Strain Host | Plasmids | Induced | Average 24 Hour Titer | Standard Deviation | 20 Hour Specific Productivity | 24 Hour Product/Cell Ratio |
|---|---|---|---|---|---|---|---|
| BX3_0275 | BW25113 | 1) pTrc-ptrc-mcr-kan 2) pACYC184-cat-PtpiA-accAD-PrpiA-accBC-ptalA-pntAB | yes | <0.001 | 0.000 | <0.001 | <0.001 |
| BX3_0284 | BW25113 | 1) pTrc-ptrc-mcr-kan 2) pACYC184-cat-PtpiA-accAD-PrpiA-accBC-ptalA-udhA | yes | <0.001 | 0.000 | <0.001 | <0.001 |
| BX3_0285 | BX_00591 | 1) pTrc-ptrc-mcr-kan | yes | <0.001 | 0.000 | <0.001 | <0.001 |
| BX3_0286 | BX_00591 | 1) pTrc-ptrc-mcr-kan 2) pJ251-cat-PtpiA-accAD-PrpiA-accBC | yes | <0.001 | 0.000 | <0.001 | <0.001 |
| BX3_0287 | BX_00591 | 1) pTrc-ptrc-mcr-kan 2) pACYC184-cat-PtalA-pntAB | yes | <0.001 | 0.000 | <0.001 | <0.001 |
| BX3_0288 | BX_00591 | 1) pTrc-ptrc-mcr-kan 2) pACYC184-cat-PtpiA-accAD-PrpiA-accBC-ptalA-pntAB | yes | <0.001 | 0.000 | <0.001 | <0.001 |
| BX3_0289 | BX_00591 | 1) pTrc-ptrc-mcr-kan 2) pACYC184-cat-PtpiA-accAD-PrpiA-accBC-ptalA-udhA | yes | <0.001 | 0.000 | <0.001 | <0.001 |
| BX3_0239 | BX_00595 | 1) pTrc-ptrc-mcr-kan | yes | 2.317 | 0.001 | 0.067 | 1.335 |
| BX3_0261 | BX_00595 | 1) pTrc-ptrc-mcr-kan 2) pJ251-cat-PtpiA-accAD-PrpiA-accBC | yes | 4.576 | 0.327 | 0.187 | 3.748 |
| BX3_0290 | BX_00595 | 1) pTrc-ptrc-mcr-kan 2) pACYC184-cat-PtalA-pntAB | yes | 1.706 | 0.396 | 0.060 | 1.194 |
| BX3_0240 | BX_00595 | 1) pTrc-ptrc-mcr-kan 2) pACYC184-cat-PtpiA-accAD-PrpiA-accBC-ptalA-pntAB | yes | 5.878 | 0.684 | 0.228 | 4.563 |
| BX3_0267 | BX_00595 | 1) pTrc-ptrc-mcr-kan, 2) pACYC184-cat-PtpiA-accAD-PrpiA-accBC-ptalA-udhA | yes | 3.440 | 0.205 | 0.160 | 2.912 |
| BX3_0253 | BX_00619 | 1) pTrc-ptrc-mcr-kan | yes | 1.327 | 0.575 | 0.034 | 0.670 |
| BX3_0254 | BX_00619 | 1) pTrc-ptrc-mcr-kan 2) pJ251-cat-PtpiA-accAD-PrpiA-accBC | yes | 3.131 | 0.058 | 0.136 | 2.711 |
| BX3_0263 | BX_00619 | 1) pTrc-ptrc-mcr-kan 2) pACYC184-cat-PtpiA-accAD-PrpiA-accBC-ptalA-pntAB | yes | 2.376 | 0.717 | 0.060 | 1.200 |
| BX3_0268 | BX_00619 | 1) pTrc-ptrc-mcr-kan 2) pACYC184-cat-PtpiA-accAD-PrpiA-accBC-ptalA-udhA | yes | 5.555 | 0.265 | 0.240 | 4.809 |
| BX3_0279 | BX_00637 | 1) pTrc-ptrc-mcr-kan 2) pJ251-cat-PtpiA-accAD-PrpiA-accBC | yes | 3.640 | 0.210 | 0.154 | 3.073 |
| BX3_0303 | BX_00637 | 1) pTrc-ptrc-mcr-kan 2) pACYC184-cat-PtalA-pntAB | yes | 2.620 | 0.085 | 0.065 | 1.297 |
| BX3_0281 | BX_00637 | 1) pTrc-ptrc-mcr-kan 2) pACYC184-cat-PtpiA-accAD-PrpiA-accBC-ptalA-pntAB | yes | 4.700 | 0.271 | 0.209 | 4.177 |
| BX3_0280 | BX_00637 | 1) pTrc-ptrc-mcr-kan 2) pACYC184-cat-PtpiA-accAD-PrpiA-accBC-ptalA-udhA | yes | 4.270 | 0.314 | 0.175 | 3.507 |
| BX3_0276 | BX_00635 | 1) pTrc-ptrc-mcr-kan 2) pJ251-cat-PtpiA-accAD-PrpiA-accBC | yes | 5.110 | 0.542 | 0.210 | 4.196 |
| BX3_0304 | BX_00635 | 1) pTrc-ptrc-mcr-kan 2) pACYC184-cat-PtalA-pntAB | yes | 2.430 | 0.147 | 0.076 | 1.512 |
| BX3_0278 | BX_00635 | 1) pTrc-ptrc-mcr-kan 2) pACYC184-cat-PtpiA-accAD-PrpiA-accBC-ptalA-pntAB | yes | 0.790 | 0.015 | 0.034 | 0.672 |

TABLE 38-continued

| Strain Name | Strain Host | Plasmids | Induced | Average 24 Hour Titer | Standard Deviation | 20 Hour Specific Productivity | 24 Hour Product/Cell Ratio |
|---|---|---|---|---|---|---|---|
| BX3_0277 | BX_00635 | 1) pTrc-ptrc-mcr-kan 2) pACYC184-cat-PtpiA-accAD-PrpiA-accBC-ptalA-udhA | yes | 6.340 | 0.580 | 0.260 | 5.207 |
| BX3_0296 | BX_00636 | 1) pTrc-ptrc-mcr-kan | yes | 3.400 | 0.139 | 0.102 | 2.032 |
| BX3_0297 | BX_00636 | 1) pTrc-ptrc-mcr-kan 2) pJ251-cat-PtpiA-accAD-PrpiA-accBC | yes | 1.830 | 0.144 | 0.069 | 1.376 |
| BX3_0298 | BX_00636 | 1) pTrc-ptrc-mcr-kan 2) pACYC184-cat-PtalA-pntAB | yes | 2.670 | 0.065 | 0.081 | 1.628 |
| BX3_0299 | BX_00636 | 1) pTrc-ptrc-mcr-kan 2) pACYC184-cat-PtpiA-accAD-PrpiA-accBC-ptalA-pntAB | yes | 3.200 | 0.418 | 0.121 | 2.412 |
| BX3_0300 | BX_00636 | 1) pTrc-ptrc-mcr-kan 2) pACYC184-cat-PtpiA-accAD-PrpiA-accBC-ptalA-udhA | yes | 4.930 | 0.638 | 0.184 | 3.671 |
| BX3_0291 | BX_00634 | 1) pTrc-ptrc-mcr-kan | yes | 1.330 | 0.138 | 0.039 | 0.783 |
| BX3_0292 | BX_00634 | 1) pTrc-ptrc-mcr-kan 2) pJ251-cat-PtpiA-accAD-PrpiA-accBC | yes | 1.209 | 0.087 | 0.030 | 0.599 |
| BX3_0293 | BX_00634 | 1) pTrc-ptrc-mcr-kan 2) pACYC184-cat-PtalA-pntAB | yes | 0.269 | 0.035 | 0.006 | 0.124 |
| BX3_0294 | BX_00634 | 1) pTrc-ptrc-mcr-kan 2) pACYC184-cat-PtpiA-accAD-PrpiA-accBC-ptalA-pntAB | yes | 1.588 | 0.136 | 0.046 | 0.927 |
| BX3_0295 | BX_00634 | 1) pTrc-ptrc-mcr-kan 2) pACYC184-cat-PtpiA-accAD-PrpiA-accBC-ptalA-udhA | yes | 1.054 | 0.048 | 0.028 | 0.552 |
| BX3_0302 | BX_00637 | 1) pTrc-ptrc-mcr-kan | yes | 3.710 | 0.221 | 0.118 | 2.352 |
| BX3_0301 | BX_00635 | 1) pTrc-ptrc-mcr-kan | yes | 3.150 | 0.576 | 0.101 | 2.027 |
| BX3_0305 | BW25113 | 1) pTrc-ptrc-mcr-kan-cynTS 2) pACYC184-cat-PtpiA-accAD-PrpiA-accBC-ptalA-pntAB | yes | 0.006 | 0.006 | 0.000 | 0.003 |
| BX3_0306 | BX_00591 | 1) pTrc-ptrc-mcr-kan-cynTS 2) pACYC184-cat-PtpiA-accAD-PrpiA-accBC-ptalA-pntAB | yes | 0.035 | 0.035 | 0.001 | 0.014 |
| BX3_0258 | BX_00595 | 1) pTrc-ptrc-mcr-kan-cynTS 2) pACYC184-cat-PtpiA-accAD-PrpiA-accBC-ptalA-pntAB | yes | 1.190 | 0.046 | 0.039 | 0.771 |
| BX3_0308 | BX_00634 | 1) pTrc-ptrc-mcr-kan-cynTS 2) pACYC184-cat-PtpiA-accAD-PrpiA-accBC-ptalA-udhA | yes | 0.401 | 0.006 | 0.011 | 0.211 |
| BX3_0310 | BX_00637 | 1) pTrc-ptrc-mcr-kan-cynTS 2) pACYC184-cat-PtpiA-accAD-PrpiA-accBC-ptalA-udhA | yes | 1.450 | 0.072 | 0.045 | 0.897 |
| BX3_0309 | BX_00635 | 1) pTrc-ptrc-mcr-kan-cynTS 2) pACYC184-cat-PtpiA-accAD-PrpiA-accBC-ptalA-udhA | yes | 4.079 | 0.054 | 0.155 | 3.098 |
| BX3_0311 | BX_00638 | 1) pTrc-ptrc-mcr-kan 2) pACYC184-cat-PtpiA-accAD-PrpiA-accBC-ptalA-udhA | yes | 3.040 | 0.227 | 0.119 | 2.387 |
| BX3_0312 | BX_00639 | 1) pTrc-ptrc-mcr-amp 2) pACYC184-cat-PtpiA-accAD-PrpiA-accBC-ptalA-udhA | yes | 2.850 | 0.071 | 0.152 | 3.030 |

TABLE 38-continued

| Strain Name | Strain Host | Plasmids | Induced | Average 24 Hour Titer | Standard Deviation | 20 Hour Specific Productivity | 24 Hour Product/Cell Ratio |
|---|---|---|---|---|---|---|---|
| BX3_0352 | BX_0651 | 1) pTrc-ptrc-mcr-kan | yes | <0.001 | 0.000 | <0.001 | NA |
| BX3_0353 | BX_0651 | 1) pTrc-ptrc-mcr-kan 2) pJ251-cat-PtpiA-accAD-PrpiA-accBC | yes | <0.001 | 0.000 | <0.001 | NA |
| BX3_0313 | BX_00635 | 1) pACYC177-kan-ptrc-mcr | no | 0.037 | 0.009 | 0.001 | 0.027 |
| BX3_0313 | BX_00635 | 1) pACYC177-kan-ptrc-mcr | yes | 0.031 | 0.009 | 0.001 | 0.023 |
| BX3_0335 | BX_00635 | 1) pACYC177-kan-ptrc-mcr-PtpiA-accAD-PrpiA-accBC | no | 0.037 | 0.021 | 0.001 | 0.020 |
| BX3_0335 | BX_00635 | 1) pACYC177-kan-ptrc-mcr-PtpiA-accAD-PrpiA-accBC | yes | 0.037 | 0.021 | 0.001 | 0.020 |
| BX3_0349 | BX_00591 | 1) pTrc-ptrc-(366-1220)mcr-ptrc-ydfG-kan | yes | 0.057 | 0.006 | 0.001 | 0.025 |
| BX3_0350 | BX_00595 | 1) pTrc-ptrc-(366-1220)mcr-ptrc-ydfG-kan | yes | 1.163 | 0.045 | 0.023 | 0.457 |
| BX3_0351 | BX_00635 | 1) pTrc-ptrc-(366-1220)mcr-ptrc-ydfG-kan 2) pACYC184-cat-PtpiA-accAD-PrpiA-accBC-ptalA-udhA | yes | 0.658 | 0.060 | 0.020 | 0.390 |
| BX3_0358 | BX_00591 | 1) pTrc-ptrc-ydfG-ptrc-(496-1220)mcr-amp | yes | 0.040 | 0.000 | 0.001 | 0.015 |
| BX3_0360 | BX_00635 | 1) pTrc-ptrc-ydfG-ptrc-(496-1220)mcr-amp 2) pACYC184-cat-PtpiA-accAD-PrpiA-accBC-ptalA-udhA | yes | 4.027 | 0.185 | 0.138 | 2.761 |
| BX3_0314 | BX_00635 | 1) pTrc-ptrc-mcr-kan-PtpiA-serA 2) pACYC184-cat-PtpiA-accAD-PrpiA-accBC-ptalA-udhA | yes | 1.170 | 0.118 | 0.055 | 1.101 |
| BX3_0315 | BX_00591 | 1) pACYC177-kan-ptrc-mcr | no | 0.013 | 0.006 | 0.000 | 0.008 |
| BX3_0316 | BX_00595 | 1) pACYC177-kan-ptrc-mcr | no | 0.010 | 0.012 | 0.000 | 0.007 |
| BX3_0333 | BX_00591 | 1) pACYC177-kan-ptrc-mcr-PtpiA-accAD-PrpiA-accBC | no | 0.005 | 0.004 | 0.000 | 0.002 |
| BX3_0334 | BX_00595 | 1) pACYC177-kan-ptrc-mcr-PtpiA-accAD-PrpiA-accBC | no | 0.300 | 0.013 | 0.007 | 0.134 |
| BX3_0317 | BX_00591 | 1) pACYC177-kan-ptrc-mcr 2) pTrc-ptrc-fabF-amp | no | <0.001 | 0.000 | <0.2 | <0.2 |
| BX3_0317 | BX_00591 | 1) pACYC177-kan-ptrc-mcr 2) pTrc-ptrc-fabF-amp | yes | 0.033 | 0.024 | 0.001 | 0.021 |
| BX3_0338 | BX_00591 | 1) pACYC177-kan-ptrc-mcr-PtpiA-accAD-PrpiA-accBC 2) pTrc-ptrc-fabF-amp | no | 0.010 | 0.005 | 0.000 | 0.004 |
| BX3_0338 | BX_00591 | 1) pACYC177-kan-ptrc-mcr-PtpiA-accAD-PrpiA-accBC 2) pTrc-ptrc-fabF-amp | yes | 1.580 | 0.142 | 0.006 | 0.116 |
| BX3_0318 | BX_00595 | 1) pACYC177-kan-ptrc-mcr 2) pTrc-ptrc-fabF-amp | no | 0.161 | 0.013 | 0.005 | 0.097 |
| BX3_0318 | BX_00595 | 1) pACYC177-kan-ptrc-mcr 2) pTrc-ptrc-fabF-amp | yes | 1.330 | 0.101 | 0.049 | 0.976 |
| BX3_0339 | BX_00595 | 1) pACYC177-kan-ptrc-mcr-PtpiA-accAD-PrpiA-accBC 2) pTrc-ptrc-fabF-amp | no | 0.083 | 0.015 | 0.007 | 0.149 |
| BX3_0339 | BX_00595 | 1) pACYC177-kan-ptrc-mcr-PtpiA-accAD-PrpiA-accBC 2) pTrc-ptrc-fabF-amp | yes | 0.010 | 0.009 | 0.000 | 0.007 |

TABLE 38-continued

| Strain Name | Strain Host | Plasmids | Induced | Average 24 Hour Titer | Standard Deviation | 20 Hour Specific Productivity | 24 Hour Product/Cell Ratio |
|---|---|---|---|---|---|---|---|
| BX3_0319 | BX_00635 | 1) pACYC177-kan-ptrc-mcr 2) pTrc-ptrc-fabF-amp | no | 0.120 | 0.008 | 0.005 | 0.094 |
| BX3_0319 | BX_00635 | 1) pACYC177-kan-ptrc-mcr 2) pTrc-ptrc-fabF-amp | yes | 1.068 | 0.450 | 0.043 | 0.854 |
| BX3_0341 | BX_00635 | 1) pACYC177-kan-ptrc-mcr-PtpiA-accAD-PrpiA-accBC 2) pTrc-ptrc-fabF-amp | no | 0.327 | 0.021 | 0.009 | 0.171 |
| BX3_0341 | BX_00635 | 1) pACYC177-kan-ptrc-mcr-PtpiA-accAD-PrpiA-accBC 2) pTrc-ptrc-fabF-amp | yes | 0.140 | 0.017 | 0.015 | 0.293 |
| BX3_0342 | BX_00635 | 1) pTrc-ptrc-mcr-kan 2) pACYC184-cat-PtpiA-accAD-PrpiA-accBC-T5-udhA | yes | 0.341 | 0.055 | 0.009 | 0.188 |
| BX3_0343 | BX_00635 | 1) pTrc-ptrc-mcr-kan-cynTS 2) pACYC184-cat-PtpiA-accAD-PrpiA-accBC-T5-udhA | yes | 1.927 | 0.047 | 0.077 | 1.536 |
| BX3_0344 | BX_00652 | 1) pTrc-ptrc-mcr-amp | yes | 1.562 | 0.280 | 0.040 | 0.797 |
| BX3_0345 | BX_00652 | 1) pTrc-ptrc-mcr-amp 2) pJ251-cat-PtpiA-accAD-PrpiA-accBC | yes | 5.195 | 0.229 | 0.184 | 3.678 |
| BX3_0346 | BX_00652 | 1) pTrc-ptrc-mcr-amp 2) pACYC184-cat-PtpiA-accAD-PrpiA-accBC-ptalA-udhA | yes | 1.781 | 0.132 | 0.056 | 1.119 |
| BX3_0347 | BX_00653 | 1) pTrc-ptrc-mcr-amp 2) pACYC184-cat-PtpiA-accAD-PrpiA-accBC-ptalA-udhA | yes | 1.370 | 0.307 | 0.049 | 0.977 |
| BX3_0348 | BX_00654 | 1) pTrc-ptrc-mcr-amp 2) pACYC184-cat-PtpiA-accAD-PrpiA-accBC-ptalA-udhA | yes | 1.387 | 0.184 | 0.049 | 0.982 |
| BX3_0324 | BX_00591 | 1) pTrc-ptrc-Ebmcr-amp | yes | 0.009 | 0.002 | 0.000 | 0.004 |
| BX3_0328 | BX_00595 | 1) pTrc-ptrc-Ebmcr-amp | yes | 0.011 | 0.005 | 0.000 | 0.006 |

Example 13B

Evaluation of BX3_240 Strain with Carbonate Addition

3-HP production in *E. coli* BX3_240 (made by methods above) was evaluated at 100-mL scale in SM3 (minimal salts) media having added sodium carbonate. SM3 used is described under the Common Methods Section, to which was added 10 mM, 20 mM and 50 mM $Na_2CO_3$ as treatments. Cultures were started from LB plates containing antibiotics by standard practice (Sambrook and Russell, 2001) into 50 mL of TB media plus the appropriate antibiotics kan and cat and grown to stationary phase overnight at 30° C. with rotation at 250 rpm. Five ml of this culture were transferred to 100 ml of SM3 media plus 30 g/L glucose, antibiotic, the indicated sodium carbonate, 0.1% yeast extract and 1 mM IPTG in triplicate 250-ml baffled flasks and incubated at 30° C., 250 rpm. Flasks were shifted to 37° C., 250 rpm after 4 hours. To monitor cell growth and 3-HP production by these cultures, samples (2 ml) were withdrawn at 24, 48 and 60 hours for optical density measurements at 600 nm ($OD_{600}$, 1 cm path length) and pelleted by centrifugation at 14000 rpm for 5 min and the supernatant collected for analysis of 3-HP production as described under "Analysis of cultures for 3-HP production" in the Common Methods section. 3-HP titer and standard deviation is expressed as g/L. Dry cell weight (DCW) is calculated as 0.33 times the measured OD600 value, based on baseline DCW per OD600 determinations. All data are the average of triplicate cultures. For comparison purposes, product to cell ratio is calculated from the averaged data over 60 hours and is expressed as g 3-HP produced per gDCW.

3-HP titer were 0.32 (+/−0.03), 0.87 (+/−0.10), 2.24 (+/−0.03), 4.15 (+/−0.27), 6.24 (+/−0.51), 7.50 (+/−0.55) and 8.03 (+/−0.14) g/L at 9, 11, 15, 19, 24, 48 and 60 hr, respectively. Biomass concentrations were 0.54 (+/−0.02), 0.79 (+/−0.03), 1.03 (+/−0.06), 1.18 (+/−0.04), 1.20 (+/−0.12), 1.74 (+/−0.30) and 1.84 (+/−0.22) at 9, 11, 15, 19, 24, 48 and 60 hr, respectively. Maximum product to cell ratio was 4.6 g 3-HP/g DCW.

Example 14

General Example of Genetic Modification to a Host Cell (Prophetic and Non-Specific)

In addition to the above specific examples, this example is meant to describe a non-limiting approach to genetic modification of a selected microorganism to introduce a nucleic acid sequence of interest. Alternatives and variations are provided within this general example. The methods of this example are conducted to achieve a combination of desired genetic modifications in a selected microorganism species, such as a combination of genetic modifications as described in sections herein, and their functional equivalents, such as in other bacterial and other microorganism species.

A gene or other nucleic acid sequence segment of interest is identified in a particular species (such as *E. coli* as described herein) and a nucleic acid sequence comprising that gene or segment is obtained.

Based on the nucleic acid sequences at the ends of or adjacent the ends of the segment of interest, 5' and 3' nucleic acid primers are prepared. Each primer is designed to have a sufficient overlap section that hybridizes with such ends or adjacent regions. Such primers may include enzyme recognition sites for restriction digest of transposase insertion that could be used for subsequent vector incorporation or genomic insertion. These sites are typically designed to be outward of the hybridizing overlap sections. Numerous contract services are known that prepare primer sequences to order (e.g., Integrated DNA Technologies, Coralville, Iowa USA).

Once primers are designed and prepared, polymerase chain reaction (PCR) is conducted to specifically amplify the desired segment of interest. This method results in multiple copies of the region of interest separated from the microorganism's genome. The microorganism's DNA, the primers, and a thermophilic polymerase are combined in a buffer solution with potassium and divalent cations (e.g., Mg or Mn) and with sufficient quantities of deoxynucleoside triphosphate molecules. This mixture is exposed to a standard regimen of temperature increases and decreases. However, temperatures, components, concentrations, and cycle times may vary according to the reaction according to length of the sequence to be copied, annealing temperature approximations and other factors known or readily learned through routine experimentation by one skilled in the art.

In an alternative embodiment the segment of interest may be synthesized, such as by a commercial vendor, and prepared via PCR, rather than obtaining from a microorganism or other natural source of DNA.

The nucleic acid sequences then are purified and separated, such as on an agarose gel via electrophoresis. Optionally, once the region is purified it can be validated by standard DNA sequencing methodology and may be introduced into a vector. Any of a number of vectors may be used, which generally comprise markers known to those skilled in the art, and standard methodologies are routinely employed for such introduction. Commonly used vector systems are pSMART (Lucigen, Middleton, Wis.), pET *E. coli* EXPRESSION SYSTEM (Stratagene, La Jolla, Calif.), pSC-B StrataClone Vector (Stratagene, La Jolla, Calif.), pRANGER-BTB vectors (Lucigen, Middleton, Wis.), and TOPO vector (Invitrogen Corp, Carlsbad, Calif., USA). Similarly, the vector then is introduced into any of a number of host cells. Commonly used host cells are E. cloni 10G (Lucigen, Middleton, Wis.), E. cloni 10GF' (Lucigen, Middleton, Wis.), StrataClone Competent cells (Stratagene, La Jolla, Calif.), *E. coli* BL21, *E. coli* BW25113, and *E. coli* K12 MG1655. Some of these vectors possess promoters, such as inducible promoters, adjacent the region into which the sequence of interest is inserted (such as into a multiple cloning site), while other vectors, such as pSMART vectors (Lucigen, Middleton, Wis.), are provided without promoters and with dephosphorylated blunt ends. The culturing of such plasmid-laden cells permits plasmid replication and thus replication of the segment of interest, which often corresponds to expression of the segment of interest.

Various vector systems comprise a selectable marker, such as an expressible gene encoding a protein needed for growth or survival under defined conditions. Common selectable markers contained on backbone vector sequences include genes that encode for one or more proteins required for antibiotic resistance as well as genes required to complement auxotrophic deficiencies or supply critical nutrients not present or available in a particular culture media. Vectors also comprise a replication system suitable for a host cell of interest.

The plasmids containing the segment of interest can then be isolated by routine methods and are available for introduction into other microorganism host cells of interest. Various methods of introduction are known in the art and can include vector introduction or genomic integration. In various alternative embodiments the DNA segment of interest may be separated from other plasmid DNA if the former will be introduced into a host cell of interest by means other than such plasmid.

While steps of the general prophetic example involve use of plasmids, other vectors known in the art may be used instead. These include cosmids, viruses (e.g., bacteriophage, animal viruses, plant viruses), and artificial chromosomes (e.g., yeast artificial chromosomes (YAC) and bacteria artificial chromosomes (BAC)).

Host cells into which the segment of interest is introduced may be evaluated for performance as to a particular enzymatic step, and/or tolerance or bio-production of a chemical compound of interest. Selections of better performing genetically modified host cells may be made, selecting for overall performance, tolerance, or production or accumulation of the chemical of interest.

It is noted that this procedure may incorporate a nucleic acid sequence for a single gene (or other nucleic acid sequence segment of interest), or multiple genes (under control of separate promoters or a single promoter), and the procedure may be repeated to create the desired heterologous nucleic acid sequences in expression vectors, which are then supplied to a selected microorganism so as to have, for example, a desired complement of enzymatic conversion step functionality for any of the herein-disclosed metabolic pathways. However, it is noted that although many approaches rely on expression via transcription of all or part of the sequence of interest, and then translation of the transcribed mRNA to yield a polypeptide such as an enzyme, certain sequences of interest may exert an effect by means other than such expression.

The specific laboratory methods used for these approaches are well-known in the art and may be found in various references known to those skilled in the art, such as Sambrook and Russell, Molecular Cloning: A Laboratory Manual, Third Edition 2001 (volumes 1-3), Cold Spring Harbor Laboratory Press, Cold Spring Harbor, N.Y. (hereinafter, Sambrook and Russell, 2001).

As an alternative to the above, other genetic modifications may also be practiced, such as a deletion of a nucleic acid sequence of the host cell's genome. One non-limiting method to achieve this is by use of Red/ET recombination, known to those of ordinary skill in the art and described in U.S. Pat. Nos. 6,355,412 and 6,509,156, issued to Stewart et al. and incorporated by reference herein for its teachings of this method. Material and kits for such method are available from Gene Bridges (Gene Bridges GmbH, Dresden, Germany, <<www.genebridges.com>>), and the method may proceed by following the manufacturer's instructions. Targeted deletion of genomic DNA may be practiced to alter a host cell's metabolism so as to reduce or eliminate production of undesired metabolic products. This may be used in combination with other genetic modifications such as described herein in this general example.

Example 14A

Utilization of Sucrose as the Feedstock for Production of 3-HP and Other Products (Partial Prophetic)

Common laboratory and industrial strains of *E. coli*, such as the strains described herein, are not capable of utilizing sucrose as the sole carbon source, although this property is found in a number of wild strains, including pathogenic *E. coli* strains. Sucrose, and sucrose-containing feedstocks such as molasses, are abundant and often used as feedstocks for the production by microbial fermentation of organic acids, amino acids, vitamins, and other products. Thus further derivatives of the 3-HP-producing strains that are capable of utilizing sucrose would expand the range of feedstocks that can be utilized to produce 3-HP.

Various sucrose uptake and metabolism systems are known in the art (for example, U.S. Pat. No. 6,960,455), incorporated by reference for such teachings. We describe the construction of *E. coli* strains that harbor the csc genes conferring the ability to utilize sucrose via a non-phosphotransferase system, wherein the csc genes constitute cscA, encoding a sucrose hydrolase, cscB, encoding a sucrose permease, cscK, encoding a fructokinase, and cscR, encoding a repressor. The sequences of these genes are annotated in the NCBI database as accession No. X81461 AF473544. To allow efficient expression utilizing codons that are highly abundant in *E. coli* genes, an operon containing cscB, cscK, and cscA was designed and synthesized using the services of a commercial synthetic DNA provider (DNA 2.0, Menlo Park, Calif.). The amino acid sequences of the genes are set forth as, respectively, cscB-SEQ. ID. No. 888; cscA-SEQ. ID. No. 889; csck-SEQ. ID. No. 890. The synthetic operon consisted of 60 base pairs of the region of the *E. coli* genome immediately 5' (upstream) of the adhE gene, a consensus strong promoter to drive expression of the csc genes, the coding regions for cscB, cscK, and cscA with short intergenic regions containing ribosome binding sites but no promoters, and 60 bp immediately 3' (downstream) of the adhE gene. The segments homologous to sequences flanking the adhE gene will be used to target insertion of the csc operon genes into the *E. coli* chromosome, with the concomittant deletion of adhE. The nucleotide sequence of the entire synthetic construct is shown as SEQ. ID. No. 891. The synthetic csc operon is constructed in plasmid pJ214 (DNA 2.0, Menlo Park, Calif.) that provides an origin of replication derived from plasmid p15A and a gene conferring resistance to ampicillin. This plasmid is denoted pSUCR. A suitable host cell, such as *E. coli* strain BX_595, is transformed simultaneously with pSUCR and with plasmid pTrc_kan_mcr or other suitable plasmid, and transformed strains selected for on LB medium plates containing ampicillin and kanamycin. Transformants carrying both plasmids are grown and evaluated for 3-HP production in shake flasks as described in Example 13, except that the glucose in SM3 medium is replaced with an equal concentration of sucrose.

Genes that confer functions to enable utilization of sucrose by *E. coli* can also be obtained from the natural isolate pUR400 (Cowan, P. J., et al. J. Bacteriol. 173:7464-7470, 1991) which carries genes for the phosphoenolpyruvate-dependent carbohydrate uptake phosphotransferase system (PTS). These genes consist of scrA, encoding the enzyme II component of the PTS transport complex, scrB, encoding sucrose-6 phosphate hydrolase, scrK, encoding fructokinase, and scrY, encoding a porin. These genes may be isolated or synthesized as described above, incorporated on a plasmid, and transformed into a suitable host cell, such as *E. coli* strain BX_595, simultaneously with plasmid pTrc_kan_mcr or other suitable plasmid, and transformed strains selected for on LB medium plates containing the appropriate antibiotics. Transformants carrying both plasmids are grown and evaluated for 3-HP production in shake flasks as described in Example 13, except that the glucose in SM3 medium is replaced with an equal concentration of sucrose.

Example 14B

Construction and Evaluation of Additional Strains (Prophetic)

Other strains are produced that comprise various combinations of the genetic elements (additions, deletions and modifications) described herein are evaluated for and used for 3-HP production, including commercial-scale production. The following table illustrates a number of these strains.

Additionally, a further deletion or other modification to reduce enzymatic activity, of multifunctional 2-keto-3-deoxygluconate 6-phosphate aldolase and 2-keto-4-hydroxyglutarate aldolase and oxaloacetate decarboxylase (eda in *E. coli*), may be provided to various strains. Further to the latter, in various embodiments combined with such reduction of enzymatic activity of multifunctional 2-keto-3-deoxygluconate 6-phosphate aldolase and 2-keto-4-hydroxyglutarate aldolase and oxaloacetate decarboxylase (eda in *E. coli*), further genetic modifications may be made to increase a glucose transporter (e.g. galP in *E. coli*) and/or to decrease activity of one or more of heat stable, histidyl phosphorylatable protein (of PTS) (ptsH (HPr) in *E. coli*), phosphoryl transfer protein (of PTS) (ptsI in *E. coli*), and the polypeptide chain of PTS (Crr in *E. coli*).

These strains are evaluated in either flasks, or fermentors, using the methods described above. Also, it is noted that after a given extent of evaluation of strains that comprise introduced plasmids, the genetic elements in the plasmids may be introduced into the microorganism genome, such as by methods described herein as well as other methods known to those skilled in the art.

TABLE 39

| Strain | Host | Plasmids |
| --- | --- | --- |
| BX3P_001 | F-, Δ(araD-araB)567, ΔlacZ4787(:::rrnB-3), LAM-, rph-1, Δ(rhaD-rhaB)568, hsdR514, ΔldhA::frt, ΔpflB::frt, ΔmgsA::frt, ΔpoxB::frt Δpta-ack::frt, fabIts (S241F)-zeoR T5 aceEF, T5-pntAB, T5-udhA, fabB-tS | 1) ptrc-mcr |
| BX3P_002 | F-, Δ(araD-araB)567, ΔlacZ4787(:::rrnB-3), LAM-, rph-1, Δ(rhaD-rhaB)568, hsdR514, ΔldhA::frt, ΔpflB::frt, ΔmgsA::frt, ΔpoxB::frt Δpta-ack::frt, fabIts (S241F)-zeoR T5 aceEF, T5-pntAB, T5-udhA, fabB-tS | 1) ptrc-mcr, 2) accABCD |

TABLE 39-continued

| Strain | Host | Plasmids |
|---|---|---|
| BX3P_003 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, fabB-tS | 1) ptrc-mcr, 2) accABCD-udhA |
| BX3P_004 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt Δpta-ack::frt, fabIts (S241F)-zeoR T5 aceEF, T5-pntAB, T5-udhA, relA, spoT | 1) ptrc-mcr |
| BX3P_005 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, relA, spoT | 1) ptrc-mcr, 2) accABCD |
| BX3P_006 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, relA, spoT | 1) ptrc-mcr, 2) accABCD-udhA |
| BX3P_007 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, del-arcA:kan | 1) ptrc-mcr |
| BX3P_008 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, del-arcA:kan | 1) ptrc-mcr, 2) accABCD |
| BX3P_009 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, del-arcA:kan | 1) ptrc-mcr, 2) accABCD-udhA |
| BX3P_010 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt Δpta-ack::frt, fabIts (S241F)-zeoR T5 aceEF, T5-pntAB, T5-udhA, del-aldA, del puuC, del arcA, del aldB, spoT, relA, T5-cynTS | 1) ptrc-mcr |
| BX3P_011 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del arcA, del aldB, spoT, relA, T5-cynTS | 1) ptrc-mcr, 2) accABCD |
| BX3P_012 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del arcA, del aldB, spoT, relA, T5-cynTS | 1) ptrc-mcr, 2) accABCD-udhA |
| BX3P_013 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del arcA, del aldB, spoT, relA, T5-cynTS, fabB-ts | 1) ptrc-mcr |
| BX3P_014 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del arcA, del aldB, spoT, relA, T5-cynTS, fabB-ts | 1) ptrc-mcr 2) accABCD, |
| BX3P_015 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del arcA, del aldB, spoT, relA, T5-cynTS, fabB-ts | 1) ptrc-mcr, 2) accABCD-udhA |
| BX3P_016 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, T5-cynTS | 1) ptrc-mcr |
| BX3P_017 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, T5-cynTS | 1) ptrc-mcr, 2) accABCD |
| BX3P_018 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA T5-cynTS | 1) ptrc-mcr, 2) accABCD-udhA |
| BS3P_019 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del puuC, del arcA, del aldB, spoT, relA, T5-cynTS | 1) ptrc-mcr |
| BX3P_020 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del puuC, del arcA, del aldB, spoT, relA, T5-cynTS | 1) ptrc-mcr, 2) accABCD |
| BX3P_021 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA del puuC, del arcA, del aldB, spoT, relA, T5-cynTS | 1) ptrc-mcr, 2) accABCD-udhA |

TABLE 39-continued

| Strain | Host | Plasmids |
|---|---|---|
| BX3P_022 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del aldB, spoT, relA, T5-cynTS, fabB-ts | 1) ptrc-mcr |
| BX3P_023 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del aldB, spoT, relA, T5-cynTS, fabB-ts | 1) ptrc-mcr, 2) accABCD |
| BX3P_024 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR T5 aceEF, T5-pntAB, T5-udhA, del-aldA, del puuC, del aldB, spoT, relA, T5-cynTS, fabB-ts | 1) ptrc-mcr, 2) accABCD-udhA |
| BX3P_025 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) pKK223-metE C645A |
| BX3P_026 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) pKK223-ct his-thrA |
| BX3P_027 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) pKK223-aroH*457 |
| BX3P_028 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) psmart-hcamp-cadA |
| BX3P_029 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) psmart-hcamp-metC |
| BX3P_030 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) psmart-hcamp-nrdAB |
| BX3P_031 | F-, Δ(araD-araB)567, ΔlacZ4787(::rrnB-3), LAM-, rph-1, Δ(rhaD-rhaB)568, hsdR514, ΔldhA::frt, ΔpflB::frt, ΔmgsA::frt, ΔpoxB::frt, Δpta-ack::frt, fabIts (S241F)-zeoR, T5-pntAB, T5-aceEF, T5-udhA-BSD | 1) pACYC-mcr-accABCD, 2) psmart-hcamp-prs |

Example 15

Prophetic Example of 3-HP Production

An inoculum of a genetically modified microorganism that possesses a 3-HP production pathway and other genetic modifications as described above is provided to a culture vessel to which also is provided a liquid media comprising nutrients at concentrations sufficient for a desired bio-process culture period.

The final broth (comprising microorganism cells, largely 'spent' media and 3-HP, the latter at concentrations, in various embodiments, exceeding 1, 2, 5, 10, 30, 50, 75 or 100 grams/liter) is collected and subjected to separation and purification steps so that 3-HP is obtained in a relatively purified state. Separation and purification steps may proceed by any of a number of approaches combining various methodologies, which may include centrifugation, concentration, filtration, reduced pressure evaporation, liquid/liquid phase separation (including after forming a polyamine-3-HP complex, such as with a tertiary amine such as CAS#68814-95-9, Alamine® 336, a triC$_{8-10}$ alkyl amine (Cognis, Cincinnati, Ohio or Henkel Corp.), membranes, distillation, and/or other methodologies recited in this patent application, incorporated herein. Principles and details of standard separation and purification steps are known in the art, for example in "Bioseparations Science and Engineering," Roger G. Harrison et al., Oxford University Press (2003), and Membrane Separations in the Recovery of Biofuels and Biochemicals—An Update Review, Stephen A. Leeper, pp. 99-194, in Separation and Purification Technology, Norman N. Li and Joseph M. Cabo, Eds., Marcel Dekker (1992), incorporated herein for such teachings. The particular combination of methodologies is selected from those described herein, and in part is based on the concentration of 3-HP and other components in the final broth.

Example 16

Prophetic Example of Conversion of 3-HP to Specified Downstream Chemicals

3-HP such as from Example 13 is converted to any one or more of propriolactone via a ring-forming internal esterification reaction (eliminating a water molecule), ethyl-3-HP via esterification with ethanol, malonic acid via an oxidation reaction, and 1,3-propanediol via a reduction reaction.

Example 17

Prophetic Example of Bio-Acrylic Acid Production from 3-HP

3-HP is obtained in a relatively pure state from a microbial bio-production event, such as is described in Example 15. The 3-HP is converted to acrylic acid by a dehydration reaction, such as by heating under vacuum in the presence of a catalyst. More particularly, an aqueous solution of 3-HP as an acid or salt is added to a rotatable flask with a catalyst selected from Table 8, incorporated into this example from Section XI above.

The temperature is raised to between 100 and 190° C. while under rotation and vacuum, with vapors collected at a condenser. Acrylic acid is collected as condensate and quantified such as by analytic procedures described herein. Various combinations of parameters, such as temperature, rate of change of temperature, purity of 3-HP solution derived from the microbial bio-production event, reduced pressure (and rate of change of pressure), and type and concentration of one or more catalysts, are evaluated with objectives of high conversion rate without undesired side reactions, which might, in some production scenarios, include undesired polymerization of acrylic acid.

Example 18

Alternative Prophetic Example of Bio-Acrylic Acid Production from 3-HP

3-HP is obtained in a relatively pure state from a microbial bio-production event, such as is described in Example 15. The 3-HP is converted to acrylic acid by a dehydration reaction, such as by heating under vacuum in the presence of a catalyst, however under conditions favoring a controlled polymerization of acrylic acid after its formation from 3-HP. Various combinations of parameters, such as temperature, rate of change of temperature, including removal of heat generated during reaction, purity of 3-HP solution derived from the microbial bio-production event, reduced pressure (and rate of change of pressure), and type and concentration of one or more catalysts and/or exposure to light, are evaluated with objectives of high conversion rate without undesired side reactions. Acrylic acid so formed may be separated and purified by methods known in the art, such as those methods disclosed, supra.

Example 19

Prophetic Example of Conversions of Acrylic Acid to Downstream Products

The acrylic acid of Example 17 is further converted to one (or more) of the downstream products as described herein. These conversions proceed such as by organic synthesis reactions known to those skilled in the art. Any of these conversions of 3-HP may proceed via a chemical synthesis reaction under controlled conditions to attain a high conversion rate and yield with acceptably low by-product formation. For example, the conversion method is esterification with methanol to produce methyl acrylate, or other esterifications with other alcohols for other acrylate esters, amidation to produce acrylamide, adding a nitrile moiety to produce acrylonitrile. Other additions are made as desired to obtain substituted downstream compounds as described herein.

Example 20

Prophetic Example of Conversion of Acrylic Acid to Polyacrylic Acid

The acrylic acid of Example 17 is further converted to a polyacrylic acid by heating the acrylic acid in an aqueous solution and initiating a polymerization reaction by exposing the solution to light, and thereafter controlling the temperature and reaction rate by removing heat of the polymerization.

The specific methods and teachings of the specification, and/or cited references that are incorporated by reference, may be incorporated into the above examples. Also, production of 3-HP, or one of its downstream products such as described herein, may reach at least 1, at least 2, at least 5, at least 10, at least 20, at least 30, at least 40, and at least 50 g/liter titer in various embodiments.

Example 21

Separation and Reactive Extraction of 3-HP from Fermentation Broth

A fermentation broth obtained from a 10-liter fermentor at the conclusion of a fermentation experiment was heated to 60° C. for one hour as a microorganism kill step, then adjusted to approximately 100 grams per liter of 3-HP (produced by the method described in Common Methods Section, Subsection IIIa), and pH-adjusted to approximately 7.0 with ammonium sulfate. Calcium chloride at 1 M was added as a flocculent to reach a final concentration of about 8.2 g/L. Thereafter the pH was adjusted to a pH of approximately 2.0 using sulfuric acid. Thereafter a volume of this modified fermentation broth was centrifuged at approximately 3,200 g for 5 minutes to yield a clarified broth and a pellet, which was discarded.

Portions of the clarified broth were then subjected to reactive extraction by mixing with a tertiary amine non-polar phase comprising various co-solvents. After mixing, aqueous and amine non-polar phases were allowed to separate, and the amine non-polar phase was removed from the aqueous phase, which was subjected to analysis for 3-HP concentration by HPLC (see method in Common Methods Section) Amines included Alamine 336, described above, and tripentylamine. Table 40 provides a summary of the single pass extraction efficiency into the respective amine non-polar phase solutions, each respectively calculated based on the difference between the starting 3-HP in the portion and the 3-HP in the raffinate (aqueous phase after extraction).

TABLE 40

| | | Alamine 336 Butanol 1 | Tripentylamine with indicated co-solvent: | | | |
| --- | --- | --- | --- | --- | --- | --- |
| | | | Butanol 2 | p-Xylene 3 | Methyl ethyl ketone 4 | Methyl tert-butyl ether 5 |
| start mass | G | 10.56 | 21.18 | 21.19 | 21.15 | 21.10 |
| Density | g/mL | 1.06 | 1.06 | 1.06 | 1.06 | 1.06 |
| 3-HP concentration start | g/mL | 96.85 | 96.85 | 96.85 | 96.85 | 96.85 |
| 3-HP mass start | G | 0.97 | 1.94 | 1.94 | 1.94 | 1.94 |

TABLE 40-continued

|  |  | Tripentylamine with indicated co-solvent: | | | | |
|---|---|---|---|---|---|---|
|  |  | Alamine 336 Butanol 1 | Butanol 2 | p-Xylene 3 | Methyl ethyl ketone 4 | Methyl tert-butyl ether 5 |
| mass cosolvent added | G | 8.53 | 10.18 | 10.85 | 10.13 | 9.27 |
| cosolvent density | g/mL | 0.80 | 0.80 | 0.85 | 0.79 | 0.72 |
| mass amine added | G | 8.51 | 9.90 | 9.93 | 9.90 | 9.82 |
| amine density | g/mL | 0.80 | 0.77 | 0.78 | 0.77 | 0.77 |
| mass total extractant | G | 17.04 | 20.08 | 20.78 | 20.03 | 19.09 |
| raffinate collected | G | 7.64 | 15.92 | 20.04 | 12.66 | 19.32 |
| raffinate density | g/mL | 1.08 | 1.07 | 1.07 | 1.06 | 1.08 |
| 3-HP concentration raffinate | g/L | 53.94 | 54.17 | 78.69 | 52.75 | 67.64 |
| 3-HP mass raffinate | G | 0.38 | 0.81 | 1.47 | 0.63 | 1.21 |
| % 3-HP raffinate | % | 0.39 | 0.42 | 0.76 | 0.33 | 0.62 |
| extractant collected | G | 19.22 | 24.40 | 21.26 | 28.13 | 20.07 |
| 3-HP mass extractant | G | 0.59 | 1.13 | 0.46 | 1.31 | 0.73 |
| % 3-HP extracted Total | % | 0.61 | 0.58 | 0.24 | 0.67 | 0.38 |
| Total 3HP extracted | G | 0.59 | 1.13 | 0.46 | 1.31 | 0.73 |
| % 3HP extracted | % | 60.60 | 58.39 | 23.91 | 67.47 | 37.53 |

It was noted that there was substantially more emulsion formation with the Alamine 336, and the phase separation was slower, than with the tripentylamine treatments. Nonetheless, both of these tertiary amines demonstrated that 3-HP would extract from the aqueous phase into the non-polar phase (i.e., the tertiary amine with co-solvents). The co-solvents used in this example are not meant to be limiting; other co-solvents may be considered, e.g., pentanol, hexanol, heptanol, octanol, nonanol, decanol. Also, it is noted that hexane was tested as a co-solvent with tripentylamine but the data was not considered valid as this sample caused a peak shift in the HPLC analysis.

Further, as described elsewhere in this application and as generally known in the art, there are other approaches to separation, extraction, and purification of 3-HP from a fermentation broth. Accordingly, this example is not meant to be limiting.

An example of recovery of the 3-HP from the non-polar phase tertiary amine solution by back-extraction is provided in Example 22.

Example 22

3-HP Dehydration to Acrylic Acid with Acid Catalyst

Approximately 15 mL of an aqueous solution comprising about 350 grams of 3-HP per liter (produced by the method described in Common Methods Section, Subsection IIIa) was combined in a flask with approximately 15 mL of concentrated sulfuric acid. The flask was attached to a rotary evaporator apparatus (Rotovapor Model R-210, BUCHI Labortechnik AG, Switzerland), heated in a heating bath (BUCCHI, Model B-491) to 80° C. under reduced pressure (10 to 20 mbar), and the condensate was collected below a condensing apparatus operated with chilled water as the coolant. After approximately 5 hours the condensate was collected, its volume measured, and an aliquot submitted for HPLC analysis (see Common Methods Section). An aliquot of the reaction mixture in the flask also was submitted for HPLC analysis. The HPLC analysis indicated that approximately 24 grams per liter of acrylic acid was obtained in the condensate, whereas approximately 4.5 grams per liter remained in the reaction mixture of the flask. Thus, 3-HP was shown to form acrylic acid under these conditions. This example is not meant to be limiting.

Example 23

Prophetic Example of Conversion of Acrylic Acid to Polyacrylic Acid

Acrylic acid, such as that provided in Example 22, is further converted to a polyacrylic acid by heating the acrylic acid in an aqueous solution and initiating a free-radical polymerization reaction by exposing the solution to light, and thereafter controlling the temperature and reaction rate by removing heat of the polymerization.

Batch polymerization is utilized, wherein acrylic acid is dissolved in water at a concentration of about 50 wt %. The monomer solution is deoxygenated by bubbling nitrogen through the solution. A free-radical initiator, such as an organic peroxide, is optionally added (to assist the initiation via the light source) and the temperature is brought to about 60° C. to start polymerization.

The molecular mass and molecular mass distribution of the polymer are measured. Optionally, other polymer properties including density, viscosity, melting temperature, and glass-transition temperature are determined.

The specific methods and teachings of the specification, and/or cited references that are incorporated by reference, may be incorporated into the above examples. Also, production of 3-HP, or one of its downstream products such as described herein, may reach at least 1, at least 2, at least 5, at least 10, at least 20, at least 30, at least 40, and at least 50 g/liter titer in various embodiments.

Example 24

Prophetic Example of Bulk Polymerization of Acrylic Acid to Polyacrylic Acid

Acrylic acid, such as that provided in Example 22, is further converted to a polyacrylic acid by bulk polymerization. Acrylic acid monomer, monomer-soluble initiators, and neutralizing base are combined in a polymerization reactor. Polymerization is initiated, and temperature is controlled to attain a desired conversion level. Initiators are well-known in the art and include a range of organic peroxides and other compounds, such as discussed above. The acrylic acid or polyacrylic acid is at least partially neutralized with a base such as sodium hydroxide.

The molecular mass and molecular mass distribution of the polymer are measured. Optionally, other polymer properties including density, viscosity, melting temperature, and glass-transition temperature are determined.

The polyacrylic acid produced is intended for use as a superabsorbent polymer, as an absorbent for water and aqueous solutions for diapers, adult incontinence products, feminine hygiene products, and similar consumer products, as well as for possible uses in agriculture, horticulture, and other fields.

Example 25

Prophetic Example of Production of a Superabsorbent Polymer

Acrylic acid, such as that provided in Example 22, is further converted to a superabsorbent polyacrylic acid by solution polymerization. An aqueous solution of acrylic acid monomer (at about 25-30 wt %), initiators, neutralizing base, antioxidants, crosslinkers (such as trimethylolpropane triacrylate) and optionally other additives are combined in a polymerization reactor and polymerization is initiated. Bases that can be used for neutralization include but are not limited to sodium carbonate, sodium hydroxide, and potassium hydroxide.

The reactor contents are deoxygenated for 60 minutes. The temperature of the polymerization reaction is allowed to rise to an initial desired level. The reactor is then maintained at a desired hold temperature for a period of time necessary for the desired monomer conversion to be achieved. The resulting reaction product is in the form of a high-viscosity gel. The high-viscosity, gel-like reaction product is then processed into a film or a strand, dried and ground into particles which are screened or classified into various particle size fractions. After the polymer is dried and ground to final particulate size, it is analyzed for residual acrylic acid and other chemicals, extractable centrifuge capacity, shear modulus, and absorption under load. Other polymer properties may be measured, including molecular mass, molecular mass distribution, density, viscosity, melting temperature, and glass-transition temperature. Surface treatments may be performed by adding a cross-linking co-monomer to the surface of the polymer particles.

The polyacrylic acid produced is intended for use as a superabsorbent polymer, as an absorbent for water and aqueous solutions for diapers, adult incontinence products, feminine hygiene products, and similar consumer products, as well as for possible uses in agriculture, horticulture, and other fields.

Example 26

Alternative Prophetic Example of Production of a Superabsorbent Polymer

Acrylic acid, such as that provided in Example 22, is further converted to a superabsorbent polyacrylic acid by suspension polymerization. An aqueous phase comprising water, acrylic acid monomer, and neutralizing base is combined with an oil phase comprising an inert hydrophobic liquid and optionally a suspending agent is further provided. The aqueous phase and the oil phase are contacted under conditions (including a temperature of about 75° C.) such that fine monomer droplets are formed. Polymerization is initiated, and the polymerized microparticles of polyacrylic acid are recovered from the suspension using a centrifuge.

The polyacrylic acid is then dried and ground into particles which are screened or classified into various particle size fractions. After the polymer is dried and ground to final particulate size, it is analyzed for residual acrylic acid and other chemicals, extractable centrifuge capacity, shear modulus, and absorption under load. Other polymer properties may be measured, including molecular mass, molecular mass distribution, density, viscosity, melting temperature, and glass-transition temperature.

The polyacrylic acid produced is intended for use as a superabsorbent polymer, as an absorbent for water and aqueous solutions for diapers, adult incontinence products, feminine hygiene products, and similar consumer products, as well as for possible uses in agriculture, horticulture, and other fields.

Example 27

Prophetic Example of Conversion of Acrylic Acid to Methyl Acrylate

Acrylic acid, such as that provided in Example 22, is converted to methyl acrylate by direct, catalyzed esterification. Acrylic acid is contacted with methanol, and the mixture is heated to about 50° C. in the presence of an esterification catalyst. Water formed during esterification is removed from the reaction mixture by distillation. The progress of the esterification reaction is monitored by measuring the concentration of acrylic acid and/or methanol in the mixture.

Reactive with other monomers and imparting strength and durability to acrylic co-polymers, methyl acrylate is a useful monomer for coatings for leather, paper, floor coverings and textiles. Resins containing methyl acrylate can be formulated as elastomers, adhesives, thickeners, amphoteric surfactants, fibers and plastics. Methyl Acrylate is also used in production of monomers used to make water treatment materials and in chemical synthesis.

Example 28

Prophetic Example of Conversion of Acrylic Acid to Ethyl Acrylate

Acrylic acid, such as that provided in Example 19, is converted to ethyl acrylate by direct, catalyzed esterification. Acrylic acid is contacted with ethanol, and the mixture is heated to about 75° C. in the presence of an esterification catalyst. Water formed during esterification is removed from the reaction mixture by distillation. The progress of the esterification reaction is monitored by measuring the concentration of acrylic acid and/or ethanol in the mixture.

Ethyl acrylate is used in the production of homopolymers and co-polymers for use in textiles, adhesives and sealants. Ethyl acrylate is also used in the production of co-polymers, for example acrylic acid and its salts, esters, amides, methacrylates, acrylonitrile, maleates, vinyl acetate, vinyl chloride, vinylidene chloride, styrene, butadiene and unsaturated polyesters. In addition, ethyl acrylate is used in chemical synthesis.

Example 29

Prophetic Example of Conversion of Acrylic Acid to Butyl Acrylate

Acrylic acid, such as that provided in Example 22, is converted to butyl acrylate by direct, catalyzed esterification. Acrylic acid is contacted with 1-butanol, and the mixture is heated to about 100° C. in the presence of an esterification catalyst. Water formed during esterification is removed from the reaction mixture by distillation. The progress of the esterification reaction is monitored by measuring the concentration of acrylic acid and/or ethanol in the mixture.

Butyl acrylate is used in the production of homopolymers and co-polymers for use in water-based industrial and architectural paints, enamels, adhesives, caulks and sealants, and textile finishes, utilizing homopolymers and co-polymers with methacrylates, acrylonitrile, maleates, vinyl acetate, vinyl chloride, vinylidene chloride, styrene, butadiene or unsaturated polyesters.

Example 30

Prophetic Example of Conversion of Acrylic Acid to Ethylhexyl Acrylate

Acrylic acid, such as that provided in Example 22, is converted to ethylhexyl acrylate by direct, catalyzed esterification. Acrylic acid is contacted with 2-ethyl-1-hexanol, and the mixture is heated to about 120° C. in the presence of an esterification catalyst. Water formed during esterification is removed from the reaction mixture by distillation. The progress of the esterification reaction is monitored by measuring the concentration of acrylic acid and/or ethanol in the mixture.

Ethylhexyl acrylate is used in the production of homopolymers and co-polymers for caulks, coatings and pressure-sensitive adhesives, paints, leather finishing, and textile and paper coatings.

Example 31

Prophetic Example of Conversion of Acrylates to End Products, Including Consumer Products One or more acrylates as provided in Examples 24-27 is further converted to one or more of adhesives, surface coatings, water-based coatings, paints, inks, leather finishes, paper coatings, film coatings, plasticizers, or precursors for flocculants. Such conversions to end products employ methods known in the art.

Example 32

Prophetic Example of Acrylic-Based Paint Manufacture

An aqueous dispersion comprising at least one particulate water-insoluble copolymer that includes one or more of acrylic acid, ethyl acrylate, methyl acrylate, 2-ethylhexyl acrylate, butyl acrylate, lauryl acrylate or other copolymer obtained from acrylic acid converted from 3-HP microbially produced, as described elsewhere herein, is obtained by mixing such components together under sufficient agitation to form a stable dispersion of the copolymers. The copolymers have an average molecular weight that is at least 50,000, with the copolymer particles having diameters in the range of 0.5 to 3.0 microns, Other components in the aqueous dispersion may include pigment, filler (e.g., calcium carbonate, aluminum silicate), solvent (e.g., acetone, benzol, alcohols, etc., although these are not found in certain no VOC paints), thickener, and additional additives depending on the conditions, applications, intended surfaces, etc.

In variations of such acrylic-based paints, co-polymers in addition to the acrylic-based polymers may be added. Such other co-polymers may include, but are not limited to vinyl acetate, vinyl fluoride, vinylidene chloride, methacrylic acid, itaconic acid, maleic acid, and styrene.

Example 33

Prophetic Example of Conversion of 3-HP to 1,3-Propanediol

Acrylic acid, such as that provided in Example 22, is converted to 1,3-propanediol. 3-HP is hydrogenated in the presence of an unsupported ruthenium catalyst, in a liquid phase, to prepare 1,3-propanediol. The liquid phase includes water and cyclohexane. The hydrogenation is carried out continuously in a stirred tank reactor at a temperature of about 150° C. and a pressure of about 1000 psi. The progress of hydrogenation is monitored by measuring the concentration of 3-HP and/or hydrogen in the reactor.

Example 34

Prophetic Example of Conversion of 3-HP to Malonic Acid

Acrylic acid, such as that provided in Example 22, is converted to malonic acid by catalytic oxidation of 3-HP by a supported catalyst comprising Rh. The catalytic oxidation is carried out in a fixed-bed reactor operated in a trickle-bed procedure. In the trickle-bed procedure the aqueous phase comprising the 3-HP starting material, as well as the oxidation products of the same and means for the adjustment of pH, and oxygen or an oxygen-containing gas can be conducted in counterflow. In order to achieve a sufficiently short reaction time, the conversion is carried out at a pH of about 8. The oxidation is carried out at a temperature of about 40° C. Malonic acid is obtained in nearly quantitative yields.

Example 35

Increased Copy of Genetic Elements in the 3HPTGC Confer Tolerance to 3-HP

Data from a SCALEs evaluation of library clone fitness related to 3-HP exposure, using the SCALEs technique, affords clear evidence of the relevance as to 3-HP tolerance of a number of genes and enzymes. From this data, and in view of fitness data from other portions of the 3HPTGC, a broad view may be obtained that appropriate modifications of any of the genes or enzymes of the 3HPTGC and/or provision of nucleic acid sequences that provide an enzyme activity of such enzymes (without necessarily encoding the entire enzyme) may result in an altered enzymatic activity that leads to increased 3-HP tolerance.

The method used to measure 3-HP tolerance conferred by genes in the 3HPTGC is summarized as follows.

Bacteria, Plasmids, and Library Construction

Wild-type *Escherichia coli* K12 (ATCC #29425) was used for the preparation of genomic DNA. Six samples of purified genomic DNA were digested with two blunt cutters AluI and RsaI (Invitrogen, Carlsbad, Calif. USA) for different respective times—10, 20, 30, 40, 50 and 60 minutes at 37 C, and then were heat inactivated at 70 C for 15 minutes. Restriction digestions were mixed and the fragmented DNA was separated based on size using agarose gel electrophoresis. Respective DNA fragments of 0.5, 1, 2, 4 and greater than 8 kb sizes were excised from the gel and purified with a gel extraction kit (Qiagen) according to manufacturer's instructions. Genomic libraries were constructed by ligation of the respective purified fragmented DNA with the pSMART-LCKAN vector (Lucigen, Middleton, Wis. USA) according to manufacturer's instructions. Each ligation product was then electroporated into E. Cloni 10G Supreme Electrocompetent Cells (Lucigen) and plated on LB+kanamycin. Colonies were harvested and plasmid DNA was extracted using Qiagen HiSpeed Plasmid Midi Kit according to manufacturer's instructions. Purified plasmid DNA of each library was introduced into *Escherichia coli* strain Mach1-T1® (Invitrogen, Carlsbad, Calif. USA) by electroporation. These cultures, representing each library—0.5, 1.0, 2.0, 4.0 and >8.0 kb of genomic DNA, were combined and incubated at 37 C to a desired density, to an $OD_{600}$ of approximately 0.50. This combined library culture mixture was used for selection. (See section herein and also see Lynch, M., Warencke, T E, Gill, R T, *SCALEs: multiscale analysis of library enrichment*. Nature Methods, 2007. 4(87-93); Warnecke, T. E., Lynch, M. D., Karimpour-Fard, A., Sandoval, N., Gill, R. T., *A genomics approach to improve the analysis and design of strain selections*. Metabolic Engineering, 2008 10(154-156)). Mach1-T1$^R$ containing pSMART-LCKAN empty vector were used for all control studies. Growth curves were done in MOPS Minimal Medium (See Neidhardt, F., *Culture medium for enterobacteria*. J Bacteriol, 1974. 119: p. 736-747.). Antibiotic concentration was 20 ug kanamycin/mL.

3-HP Preparation

3-HP was obtained from TCI America (Portland, Oreg.). Significant acrylic acid and 2-oxydipropionic contamination was observed via HPLC analysis. Samples were subsequently treated by diethyl ether extraction to remove acrylic acid and a portion of the 2-oxydipropionic contaminants. Samples were then neutralized with 10 M NaOH to a final pH of 7.0. Considerable insoluble matter was observed at neutral pH at concentrations in excess of approximately 35 g/L. Neutralized samples were centrifuged at 4000 rpm for 30 minutes at 4° C. The soluble 3-HP fraction was isolated from the thus-centrifuged insoluble matter and further analyzed by HPLC for a final quantification of concentration and purity of the working stock solution. The working stock solution was used for the selection and MIC evaluations in this example.

Selections

As noted herein, five representative genomic libraries were created from *E. coli* K12 genomic DNA with defined insert sizes of 0.5, 1, 2, 4, and 8 kb, each library was transformed into MACH1™-T1® *E. coli*, cultured and then mixed. The mixture was aliquoted into two 15 mL screw cap tubes with a final concentration of 20 g/L 3-HP (TCI America) neutralized to pH 7 with 10 M NaOH. The cell density of the selection cultures was monitored as they approached a final $OD_{600}$ of 0.3-0.4. The original selection cultures were subsequently used to inoculate another round of 15 mL MOPS minimal media+kanamycin+3-HP as part of a repeated batch selection strategy. Overall, a selection was carried out over 8 serial transfer batches with a decreasing gradient of 3-HP over 60 hours. More particularly, the 3-HP concentrations were 20 g 3-HP/L for serial batches 1 and 2, g 3-HP/L for serial batches 3 and 4, 10 g 3-HP/L for serial batches 5 and 6, and 5 g 3-HP/L for serial batches 7 and 8. For serial batches 7 and 8 the culture media was replaced as the culture approached stationary phase to avoid nutrient limitations. (Also see Warnecke, T. E., Lynch, M. D., Karimpour-Fard, A., Sandoval, N., Gill, R. T., *A genomics approach to improve the analysis and design of strain selections*. Metabolic Engineering, 2008 10(154-156), incorporated by reference herein). Batch transfer times were adjusted as needed to avoid a nutrient limited selection environment. Samples were taken at the culmination of each batch. Repeated batch cultures containing 3-HP were monitored and inoculated over a 60 hour period to enhance the concentration of clones exhibiting increased growth in the presence of 3-HP. Samples were taken by plating 1 mL of the selected population onto selective plates (LB with kanamycin) with each batch. Plasmid DNA was extracted from each sample and hybridized to Affymetrix *E. Coli* Antisense GeneChip® arrays (Affymetrix, Santa Clara, Calif.) according to previous work (See Lynch, M., Warencke, T E, Gill, R T, *SCALEs: multiscale analysis of library enrichment*. Nature Methods, 2007. 4(87-93)) and manufacturer's instructions.

Data Analysis

Data analysis was completed by utilizing SCALEs-appropriate software as described herein and also in Lynch, M., Warencke, T E, Gill, R T, *SCALEs: multiscale analysis of library enrichment*. Nature Methods, 2007. 4(87-93)). Fitness contributions from specific genomic elements were calculated from the enrichment of each region as a fraction of the selected population, as was previously described (Lynch, M., Warencke, T E, Gill, R T, *SCALEs: multiscale analysis of library enrichment*. Nature Methods, 2007. 4(87-93)). Briefly, plasmid DNA from samples taken at the culmination of each batch in the selection were hybridized to Affymetrix *E. Coli* Antisense GeneChip® arrays per above and data obtained from this was further analyzed. For each array, signal values corresponding to individual probe sets were extracted from the Affymetrix data file and partitioned into probe sets based on similar affinity values (Naef, F. and Magnasco, M. O., 2003, Solving the riddle of the bright mismatches: labeling and effective binding in oligonucleotide arrays. Phys. Rev. E 68, 011906). Background signal for each probe was subtracted according to conventional Affymetrix algorithms (MAS 5.0). Non-specific noise was determined as the intercept of the robust regression of the difference of the perfect match and mismatch signal against the perfect match signal. Probe signals were then mapped to genomic position as the tukey bi-weight of the nearest 25 probe signals and were de-noised by applying a medium filter with a 1000 bp window length. Gaps between probes were filled in by linear interpolation. This continuous signal was decomposed using an N-sieve based analysis and reconstructed on a minimum scale of 500 bp as described in detail by Lynch et al (2007). Signals were further normalized by the total repressor of primer (ROP) signal, which is on the library vector backbone and represents the signal corresponding to the total plasmid concentration added to the chip.

The analysis decomposed the microarray signals into corresponding library clones and calculated relative enrichment of specific regions over time. In this way, genome-wide fitness ($\ln(X_i/X_{i0})$) was measured based on region specific enrichment patterns for the selection in the presence of 3-HP. Genetic elements and their corresponding fitness were then segregated by metabolic pathway based on their EcoCyc classifications (ecocyc.org). This fitness matrix was used to calculate both pathway fitness (W) and frequency of enrichment found in the selected population.

$$W_{pathway} = \sum_{1}^{n} W_i$$

$$frequency = \frac{\text{number of genes from metabolic pathway}}{\text{total genes in pathway}}$$

Pathway redundancies were identified by an initial rank ordering of pathway fitness, followed by a specific assignment for genetic elements associated with multiple pathways to the primary pathway identified in the first rank, and subsequent removal of the gene-specific fitness values from the secondary pathways.

Similarly genes in a given genetic element were assigned fitness independent of neighboring genes in a genetic element as follows: The fitness of any gene was calculated as the sum of the fitness of all clones that contained that gene. This was followed by an initial rank ordering of gene fitness, followed by a specific assignment for genetic elements associated with multiple genes to the dominant gene identified in genetic element with the highest rank, with the subsequent removal of the fitness values from the non dominant genes in a genetic element.

Data was further analyzed by construction of receiver operator characteristics ("ROC") according to traditional signal detection theory (T. Fawcett, "An introduction to ROC analysis," Pattern Recog. Let. (2006)27:861-874). Data was categorized according to four standard classes—true positive, false positive, true negative, and false negative, using the fitness values for respective genetic elements per above and specific growth rates measured in the presence of 20 g/L 3-HP, using standard methods of analysis and cutoff values for fitness of 0.1, 1.0, 10 and 20 were chosen in an effort to optimize the range of true and false positive rates. A data point representing a genetic element of a clone was denoted a true positive if the reported fitness was greater than the cutoff value and the separately measured growth rate was significantly increased when compared with the negative control. A false positive had reported fitness that was greater than the cutoff value but a growth rate not significantly greater than that of the negative control. A clone was designated a true negative only if the corresponding fitness was less than the cutoff value and it yielded significantly reduced growth rates, i.e., not significantly greater than that of the negative control, and a false negative refers to a clone having a reduced fitness score but demonstrating an increased growth rate, i.e., significantly greater than that of the negative control.

An ROC curve is constructed by plotting the true positive rate (sensitivity) versus the false positive rate (1-specificity) (See T. E. Warnecke et al. Met. Engineering 10 (2008):154-165). Accordingly, it may be stated with confidence that clones (and their respective genetic elements) identified with increased fitness confer tolerance to 3-HP over the control.

Results

FIG. 9A, sheets 1-7, graphically shows the genes identified in the 3HPTGC for E. coli. In addition Table 3 gives cumulative fitness values as calculated herein for some of the genes in the 3HPTGC.

3-HP Toleragenic Complexes also were developed for the gram-positive bacterium Bacillus subtilis, for the yeast Saccharomyces cerevisiae, and for the bacterium Cupriavidus necator. These are depicted, respectively, in FIGS. 9B-D, sheets 1-7.

Example 36

Additions of 3HPTGC Products, Part 1

Based on the examples, and conceptualization of the 3HPTGC, it is possible to increase the 3-HP tolerance of a microorganism by adding limiting enzymatic conversion products (i.e., product(s) of an enzymatic conversion step) of the 3HPTGC. This example demonstrates the addition of some such products to increase 3-HP tolerance in E. coli.

Bacteria, Plasmids, and Media

Wild-type Escherichia coli K12 (ATCC #29425) was used for the preparation of genomic DNA. Mach1-T1$^R$ was obtained from Invitrogen (Carlsbad, Calif. USA).

3-HP Preparation

3-HP was obtained from TCI America (Portland, Oreg.). Significant acrylic acid and 2-oxydipropionic contamination was observed via HPLC analysis. Samples were subsequently treated by diethyl ether extraction to remove acrylic acid and a portion of the 2-oxydipropionic contaminants. Samples were then neutralized with 10 M NaOH to a final pH of 7.0. Considerable 3-HP polymerization was observed at neutral pH at concentrations in excess of approximately 35 g/L. Neutralized samples were centrifuged at 4000 rpm for 30 minutes at 4° C. The soluble 3-HP fraction was isolated from the solid polymer product and further analyzed by HPLC for a final quantification of concentration and purity of the working stock solution. The working stock solution was used for the selection, growth rates and MIC evaluations in this example.

Minimum Inhibitory Concentrations

The minimum inhibitory concentration (MIC) using commercially obtained 3-HP (TCI America, Portland, Oreg. USA, see 3-HP preparation herein) was determined microaerobically in a 96 well-plate format. Overnight cultures of strains were grown in 5 ml LB (with antibiotic where appropriate). A 1 v/v % was used to inoculate a 15 ml conical tube filled to the top with MOPS minimal media and capped. After the cells reached mid exponential phase, the culture was diluted to an OD$_{600}$ of 0.200. The cells were further diluted 1:20 and a 10 ul aliquot was used to inoculate each well (~10$^4$ cells per well). The plate was arranged to measure the growth of variable strains or growth conditions in increasing 3-HP concentrations, 0-70 g/L, in 5 g/L increments, as well as either media supplemented with optimal supplement concentrations which were determined to be: 2.4 mM tyrosine (Sigma), 3.3 mM phenylalanine (Sigma), 1 mM tryptophan (Sigma), 0.2 mM p-hydroxybenzoic acid hydrazide (MP Biomedicals), 0.2 mM p-aminobenzoic acid (MP Biomedicals), 0.2 mM 2,3-dihydroxybenzoic acid (MP Biomedicals), 0.4 mM shikimic acid (Sigma), 2 mM pyridoxine hydrochloride (Sigma), 35 uM homoserine (Acros), 45 uM homocysteine thiolactone hydrochloride (MP Biomedicals), 0.5 mM oxobutanoate (Fluka), 5 mM threonine (Sigma). The minimum inhibitory 3-HP concentration (i.e., the lowest concentration at which there is no visible growth) and the maximum 3-HP concentration corresponding to visible cell growth (OD~0.1) were recorded after 24 hours (between 24 and 25 hours, although data indicated no substantial change in results when the time period was extended).

Results

3-HP tolerance of E. coli Mach1-T1$^R$ was increased by adding the supplements to the media. The supplementation described herein resulted in the following MIC increases: 40% (tyrosine), 33% (phenylalanine), 33% (tryptophan), 33% (p-hydroxybenzoic acid hydrazide), 7% (p-aminobenzoic acid), 33% (2,3-didyroxybenzoic acid), 0% (pyridoxine hydrochloride), 33% (homoserine), 60% (homocysteine thiolactone hydrochloride), 7% (oxobutanoate), and 3% (threonine).

Example 37

Additions of 3HPTGC Products, Part 2 (Using New Source of 3-HP)

Based on the examples, and conceptualization of the 3HPTGC, it is possible to increase the 3-HP tolerance of a microorganism by adding limiting enzymatic conversion products (at least some of which alternatively may be termed "intermediates") of the 3HPTGC. This example demonstrates the addition of putrescine, spermidine, cadaverine and sodium bicarbonate to increase 3-HP tolerance in E. coli. The concept of 'limiting' as used in this context refers to a hypothesized limitation that if overcome may demonstrate increased 3-HP tolerance by a subject microorganism or system. As a non-exclusive approach, such hypothesized limitation may be confirmed experimentally, as by a demonstration of increased tolerance to 3-HP upon addition of a particular enzymatic conversion product or other compound.

Bacteria, Plasmids, and Media

Wild-type Escherichia coli K12 (ATCC #29425) was used for the preparation of genomic DNA. M9 minimal and EZ rich media are described in Subsection II of the Common Methods Section.

3-HP Preparation

3-HP was obtained from Beta-propiolactone as described in Subsection III of the Common Method Section.

Minimum Inhibitory Concentrations

The minimum inhibitory concentration (MIC) of 3-HP for E. coli (see 3-HP preparation herein) was determined aerobically in a 96 well-plate format. Overnight cultures of strains were grown in 5 ml LB (with antibiotic where appropriate) at 37° C. in a shaking incubator. A 1 v/v % was used to inoculate 10 mL of M9 minimal media. After the cells reached mid-exponential phase, the culture was diluted to an $OD_{600}$ of 0.200. The cells were further diluted 1:20 and a 10 ul aliquot was used to inoculate each well (~$10^4$ cells per well). The plate was arranged to measure the growth of variable strains or growth conditions in increasing 3-HP concentrations, 0-100 g/L, in 10 g/L increments, in M9 minimal media, supplemented with putrescine (0.1 g/L, MP Biomedicals, Santa Ana, Calif. USA), cadaverine (0.1 g/L, MP Biomedicals) or spermidine (0.1 g/L, Sigma-Aldrich, St. Louis, Mo., USA) or sodium bicarbonate (20 mM, Fisher Scientific, Pittsburgh, Pa. USA) (values in parentheses indicate final concentrations in media). The minimum inhibitory 3-HP concentration (i.e., the lowest concentration at which there is no visible growth) and the maximum 3-HP concentration corresponding to visible cell growth (OD~0.1) were recorded after 24 hours (between 24 and 25 hours, although data (not shown) indicated no substantial change in results when the time period was extended). The MIC endpoint is the lowest concentration of compound at which there was no visible growth.

Results

3-HP tolerance of E. coli was increased by adding the polyamines putrescine, spermidine and cadaverine to the media. Minimum inhibitory concentrations (MICs) for E. coli K12 in control and supplemented media were as follows: in M9 minimal media supplemented with putrescine 40 g/L, in M9 minimal media supplemented with spermidine 40 g/L, in M9 minimal media supplemented with cadavarine 30 g/L. Minimum inhibitory concentrations (MICs) for added sodium bicarbonate in M9 minimal media was 30 g/L. The Minimum inhibitory concentrations (MICs) for E. coli K12 in 100 g/L stock solution 3-HP was 20 g/L.

In view of the increase over the control MIC with sodium bicarbonate supplementation, other alteration, such as regulation and/or genetic modification of carbonic anhydrase (not presently shown in FIG. 9A1-7, but related directly to $HCO_3^-$), such as providing a heterologous nucleic acid sequence to a cell of interest, where that nucleic acid sequence encodes a polypeptide possessing carbonic anhydrase activity are considered of value to increase tolerance to 3-HP (such as in combination with other alterations of the 3HPTGC). Similarly, and as supported by other data provided herein, alterations of the enzymatic activities, such as by genetic modification(s) of enzyme(s) along the 3HPTGC pathway portions that lead to arginine, putrescine, cadaverine and spermidine, are considered of value to increase tolerance to 3-HP (such as in combination with other alterations of the 3HPTGC).

Example 38

Genetic Modification of aroH for Increased 3-HP Tolerance

Based on the identification of the tyrA-aroF operon as a genetic element conferring tolerance to 3-HP at increased copy, this enzymatic activity was further examined. The wild type aroF gene is inhibited by increasing concentrations of end products tyrosine and phenylalanine. However, to bypass this inherent feedback inhibition control, a feedback resistant mutant of the aroH gene was obtained and introduced into a cell as follows.

Clone Construction

PCR was used to amplify the E. coli K12 genomic DNA corresponding to the aroF-tyrA region with primers designed to include the upstream aroFp promoter and the rho-independent transcriptional terminators. Ligation of the purified, fragmented DNA with the pSMART-kanamycin vectors was performed with the CloneSMART kit (Lucigen, Middleton, Wis. USA) according to manufacturer's instructions. The ligation product was then transformed into chemically competent Mach1-T1$^R$ E. coli cells (Invitrogen, Carlsbad, Calif. USA), plated on LB+kanamycin, and incubated at 37° C. for 24 hours. To confirm the insertion of positive transformants, plasmids were isolated from clones using a Qiaprep Spin MiniPrep Kit from Qiagen (Valencia, Calif.) and sequenced (Macrogen, South Korea).

Plasmids containing the wild-type aroH gene (CB202) and a mutant version exhibiting resistance to tryptophan feedback inhibition (CB447) via a single amino acid change (G149D) were obtained from Ray et al (Ray, J. M., C. Yanofsky, and R. Baurele, Mutational analysis of the catalytic and feedback sites of the tryptophan-sensitive 3-deoxy-D-arabino-heptulosante-7-phosphate synthase of Escherichia coli. J Bacteriol, 1988. 170(12):p. 5500-6.). These plasmids were constructed with the pKK223-3 backbone vector containing the ptac promoter and rrNBT1 transcriptional terminator. The aroH inset DNA was amplified according to traditional PCR methodology with primers designed to include both the promoter and terminator. Purified PCR products were ligated with the pBT-1 plasmid and transformed into electrocompetent Mach1-T1® (Lynch, M. D. and R. T. Gill, A series of broad host range vectors for stable genomic library construction. Biotechnology and Bioengineering, 2006. 94(1): p. 151-158). The resulting plasmid sequence is given in (SEQ ID NO:001). Optimal induction levels were determined by minimum inhibitory concentration assays to be 0.001 mM IPTG.

MIC Comparisons

MIC evaluations were conducted as described for Example 35. A Mach1-T1® cell culture comprising the aroH mutant was compared with a control cell culture, both in MOPS minimal media.

Results

As measured by fold increase in MIC, the cells comprising the aroH mutant exhibited a MIC 1.4 times greater than the control MIC. This represents a 40 percent improvement. Accordingly, this example demonstrates one of many possible genetic modification approaches to increasing 3-HP tolerance in a selected cell, based on knowledge of the importance of the 3HPTGC in 3-HP tolerance.

Example 39

Genetic Modification via Cyanase Introduction for Increased 3-HP Tolerance

A plasmid clone containing the cynTS genes from *E. coli* K12 was obtained from selections described in Example 35. This plasmid called pSMART-LC-Kan-cynTS was isolated and purified according to standard methods. (Sequencing of the plasmid revealed a final sequence (SEQ ID NO:002)). Purified plasmid was retransformed into *E. coli* K12 by standard techniques and MIC measured as described in Example 37. 3-HP tolerance improvement by the plasmid containing the cynTS genes.

Minimum inhibitory concentrations (MICs) of 3-HP for *E. coli* K12 and *E. coli* K12+pSMART-LC-Kan-cynTS in M9 minimal media were 30 g/L, and 50 g/L respectively. Thus, an over sixty percent improvement in the MIC, signifying an increase in 3-HP tolerance, was observed in this example which comprised only one genetic modification of the 3HPTGC in the *E. coli* host cell. Accordingly, this example again demonstrates one of many possible genetic modification approaches to increasing 3-HP tolerance in a selected cell, based on knowledge of the importance of the 3HPTGC in 3-HP tolerance and appropriate use of that knowledge.

Example 40

Development of a Nucleic Acid Sequence Encoding a Protein Sequence Comprising Oxaloacetate Alpha-Decarboxylase Activity (Partial Prophetic)

Figure 16:
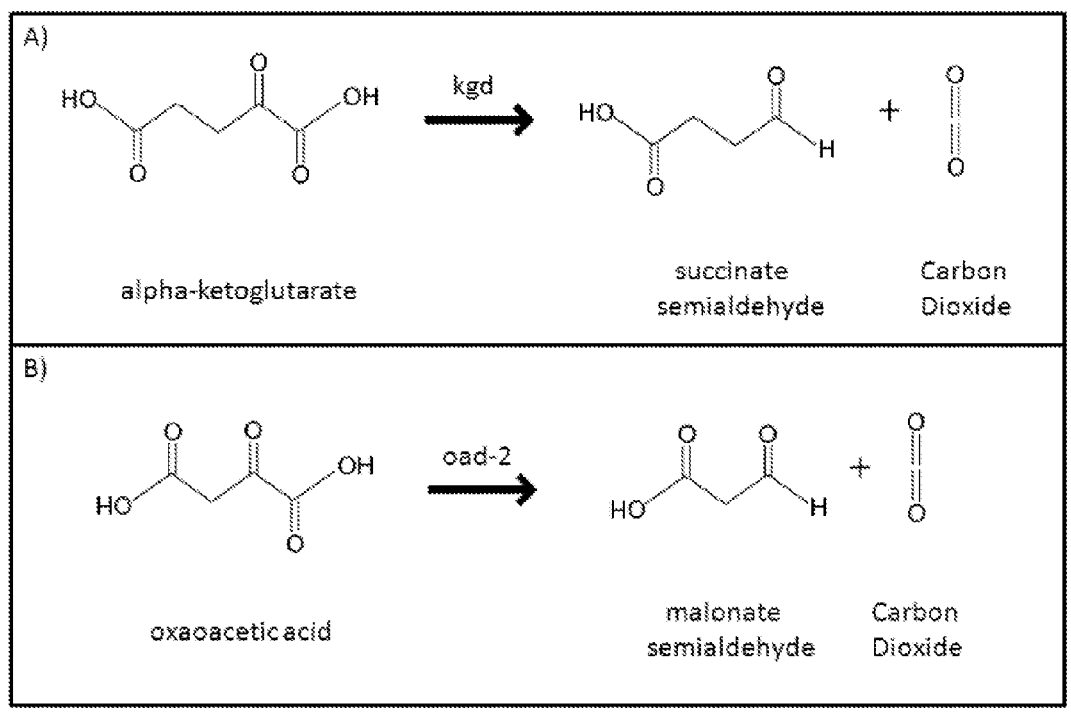
FIG. 16 depicts a known chemical reaction catalyzed by alpha-ketoglutarate encoded by the kgd gene from *M. tuberculosis*.
Figure 17:
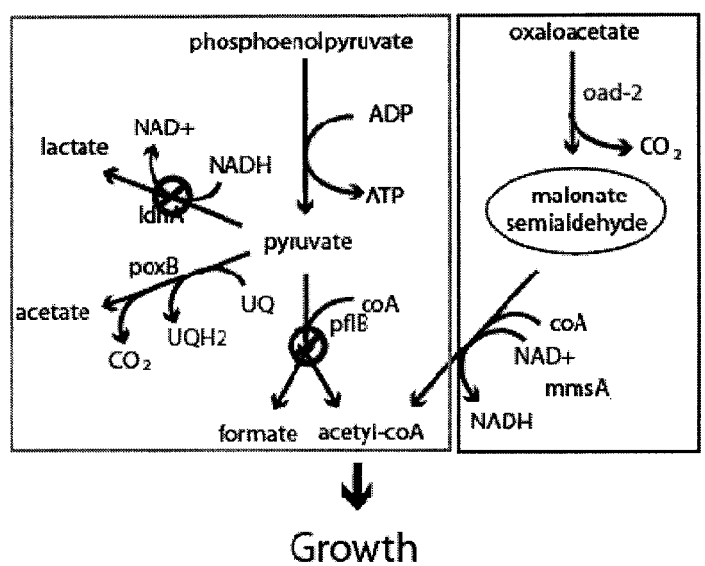
FIG. 17 depicts a new enzymatic function, the decarboxylation of oxaloacetate to malonate semialdehyde that is to be achieved by modification of the kgd gene.

Several 2-keto acid decarboxylases with a broad substrate range have been previously characterized (Pohl, M., Sprenger, G. A., Muller, M., A new perspective on thiamine catalysis. Current Opinion in Biotechnology, 15(4), 335-342 (2004)). Of particular interest is an enzyme from *M. tuberculosis*, alpha-ketoglutarate decarboxylase, which has been purified and characterized (Tian, J., Bryk, R. Itoh, M., Suematsu, M., and Carl Nathan, C. Variant tricarboxylic acid cycle in *Mycobacterium tuberculosis*: Identification of alpha-ketoglutarate decarboxylase. PNAS. Jul. 26, 2005 vol. 102 (30): 10670-10677; Stephanopoulos, G., Challenges in engineering microbes for biofuels production. Science, 2007. 315 (5813):801-804). The reaction carried out by this enzyme is depicted in FIG. 16B (FIG. 16A showing the predominant known chemical reaction by the enzyme encoded by the native kgd gene). The native kgd gene has previously been cloned, expressed and purified from *E. coli* without technical difficulty or toxic effects to the host strain (Tian, J., Bryk, R. Itoh, M., Suematsu, M., and Carl Nathan, C. Variant tricarboxylic acid cycle in *Mycobacterium tuberculosis*: Identification of alpha-ketoglutarate decarboxylase. PNAS. Jul. 26, 2005 vol. 102(30):10670-10677; Stephanopoulos, G., Challenges in engineering microbes for biofuels production. Science, 2007. 315(5813):801-804). This enzyme has also been chosen as it is unlikely to be associated with the alpha-ketoglutarate dehydrogenase. Of additional interest is that a convenient colorimetric method has been developed to assay this enzymatic activity. The kgd enzyme is evolved as provided herein to have a measurable enzymatic function depicted in FIG. 16B, the decarboxylation of oxaloacetate to malonate semialdehyde. The technical work to achieve this relies largely upon traditional selection and screening of mutants of the alpha-keto-glutarate decarboxylase that have the desired oxaloacetate alpha-decarboxylase activity.

As a first step a mutant library is constructed of the kgd gene that will be used for selections or screening. The protein sequence for the alpha-ketoglutarate decarboxylase from *M. tuberculosis* was codon optimized for *E. coli* according to a service from DNA 2.0 (Menlo Park, Calif. USA), a commercial DNA gene synthesis provider. The nucleic acid sequence was synthesized with an eight amino acid N-terminal tag to enable affinity based protein purification. This gene sequence incorporated an NcoI restriction site overlapping the gene start codon and was followed by a HindIII restriction site. In addition a Shine Delgarno sequence (i.e., a ribosomal binding site) was placed in front of the start codon preceded by an EcoRI restriction site. This gene construct was synthesized by DNA 2.0 and provided in a pJ206 vector backbone.

A circular plasmid based cloning vector termed pKK223-kgd for expression of the alpha-ketoglutarate decarboxylase in *E. coli* was constructed as follows. Plasmid DNA pJ206 containing the gene synthesized kgd gene was subjected to enzymatic restriction digestion with the enzymes EcoRI and HindIII obtained from New England BioLabs (Ipswich, Mass. USA) according to manufacturer's instructions. The digestion mixture was separated by agarose gel electrophoresis, and visualized under UV transillumination as described in Subsection II of the Common Methods Section. An agarose gel slice containing a DNA piece corresponding to the kgd gene was cut from the gel and the DNA recovered with a standard gel extraction protocol and components from Qiagen according to manufacturer's instructions. An *E. coli* cloning strain bearing pKK223-aroH was obtained as a kind gift from the laboratory of Prof. Ryan T. Gill from the University of Colorado at Boulder. Cultures of this strain bearing the plasmid were grown by standard methodologies and plasmid DNA was prepared by a commercial miniprep column from Qiagen (Valencia, Calif. USA) according to manufacturer's instructions. Plasmid DNA was digested with the restriction endonucleases EcoRI and HindIII obtained from New England BioLabs (Ipswich, Mass. USA) according to manufacturer's instructions. This digestion served to separate the aroH reading frame from the pKK223 backbone. The digestion mixture was separated by agarose gel electrophoresis, and visualized under UV transillumination as described in Subsection II of the Common Methods Section. An agarose gel slice containing a DNA piece corresponding to the backbone of the pKK223 plasmid was cut from the gel and the DNA recovered with a standard gel extraction protocol and components from Qiagen (Valencia, Calif. USA) according to manufacturer's instructions.

Pieces of purified DNA corresponding to the kgd gene and pKK223 vector backbone were ligated and the ligation product was transformed via electroporation according to manufacturer's instructions. The sequence of the resulting vector termed pKK223-kgd (SEQ ID NO:004) was confirmed by routine sequencing performed by the commercial service provided by Macrogen (Rockville, Md. USA). pKK223-kgd confers resistance to beta-lactamase and contains the kgd gene of *M. tuberculosis* under control of a ptac promoter inducible in *E. coli* hosts by IPTG.

Plasmid pKK223-kgd was propagated and purified DNA prepared by standard methodologies. Plasmids were introduced into XL1-Red chemically competent cells (Stratagene, LaJolla, Calif.) in accordance with the manufacturer's instructions, plated onto LB+100 micrograms/mL ampicillin, and incubated at 37° C. for >24 hours. Dilution cultures with 1/1000 of the original transformation volume were plated on LB+100 micrograms/mL ampicillin in triplicate. Greater than 1000 colonies were obtained, corresponding to approximately $10^7$ mutant cells per transformation. Colonies were harvested by gently scraping the plates into TB media. The cultures were immediately resuspended by vortexing, and aliquoted into 1 mL freezer stock cultures with a final glycerol concentration of 15% (v/v) (Sambrook and Russell, 2001). The remainder of the culture was pelleted by centrifugation for 15 minutes at 3000 rpm. Plasmid DNA was extracted according to the manufacturer's instructions using a HiSpeed Plasmid Midi Kit (Qiagen, Valencia, Calif.). Purified plasmid DNA from each mutant library was introduced into *E. coli* 10GF' (Lucigen, Middleton, Wis. USA) by electroporation. 1/1000 volume of this transformation was plated on LB+kanamycin in triplicate to determine transformation efficiency and adequate transformant numbers (>10^6).

The selection based approach described herein allows for the rapid identification of a kgd mutant with oxaloacetate alpha-decarboxylase activity. An available strain of *E. coli*, strain AB354, is used as a host for the selection (Bunch, P. K., F. Mat-Jan, N. Lee, and D. P. Clark. 1997. The ldhA gene encoding the fermentative lactate dehydrogenase of *Escherichia coli*. Microbiology 143:187-195). This auxotrophic *E. coli* strain has a mutation inpanD, encoding aspartate decarboxylase. The product of this reaction, beta-alanine is an essential intermediate in the synthesis of pantothenate, a precursor to coenzyme A. The block in coenzyme A synthesis confers an inability of this *E. coli* strain to grow on minimal media without supplementation (Cronoan, J. E., Little, K. J., Jackowski, S.; Genetic and Biochemical Analyses of Pantothenate Biosynthesis in *Escherichia coli* and *Salmonella typhimurium*. J. of Bacteriology, 149(3), 916-922 (1982); Cronan, J. E., Beta-Alanine Synthesis in *Escherichia coli* J. of Bacteriology, 141(3), 1291-1297 (1980)). The expression of gabT from *R. norvegicus* confers beta-alanine aminotransferase activity to *E. coli* (Tunnicliff, G.; Ngo, T. T.; Rojo-Ortega, J. M.; Barbeau, A.; The inhibition by substrate analogues of gamma-aminobutyrate aminotransferase from mitochondria of different subcellular fractions of rat brain Can. J. Biochem. 55, 479-484 (1977)). This enzyme can utilize malonate semialdehyde as a substrate to produce beta-alanine. A strain of *E. coli* AB354 expressing gabT (*E. coli* AB354+gabT) in addition to a mutant kgd gene having oxaloacetate alpha-decarboxylase activity is capable of producing the metabolite beta-alanine and have a restored ability to grown on minimal media. Expected results of the selection are depicted in FIG. 18.

Similar to the kgd gene, a codon and expression optimized *R. norvegicus* gabT gene is obtained via gene synthesis from the commercial provider DNA 2.0 (Menlo Park, Calif. USA). It is subsequently cloned into an expression plasmid.

The mutant library of kgd genes is introduced into *E. coli* strain AB354 expressing the gabT gene. This population will then be grown on minimal media plates. Individual mutants expressing the desired oxaloacetate alpha-decarboxylase activity are expected to show a restored ability to form colonies under these conditions. These clones are isolated and the mutant proteins they express subsequently are selected for oxaloacetate alpha-decarboxylase activity.

Figure 19A:
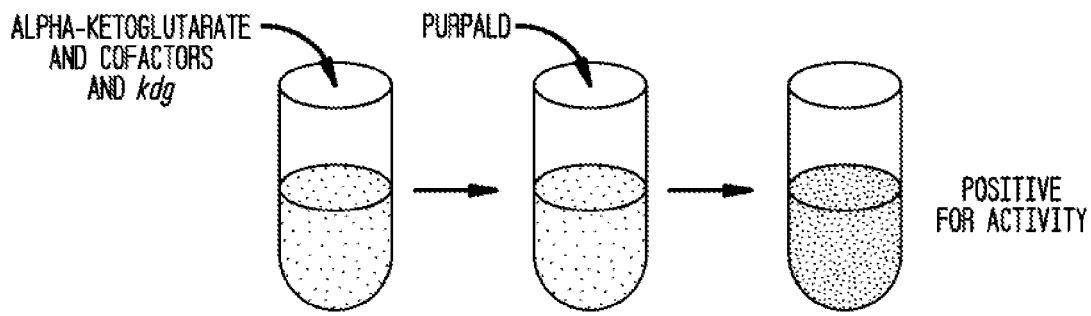
FIG. 19 shows a screening protocol related to the proposed selection approach depicted in FIG. 18.
Figure 19B:
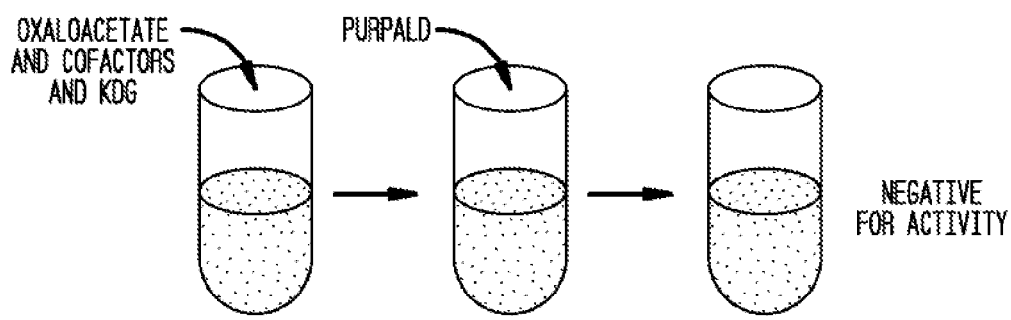
Figure 19C:
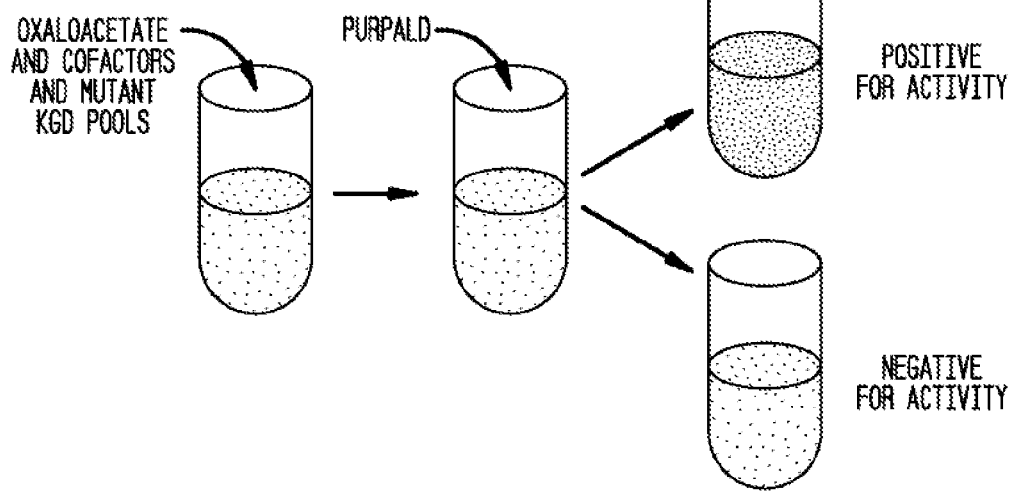

With the successful construction selection of a mutant kgd library for oxaloacetate alpha-decarboxylase activity, it will be necessary to confirm that these mutants have the desired enzymatic activity. Thus, mutants positive for oxaloacetate alpha-decarboxylase activity are confirmed for alpha-decarboxylase activity. To accomplish this, a colorimetric screening approach is taken from current standard methodologies. This approach is illustrated in FIG. 19. This approach necessitates the expression and purification of the mutant enzymes and reaction with the purified enzyme, its cofactor (thiamin pyrophosphate) and the appropriate substrate. Protein expression and purification is performed with standard methodologies.

Example 41

One-Liter Scale Bio-Production of 3-HP Using *E. coli* DF40+pKK223+MCR

Using *E. coli* strain DF40+pKK223+MCR that was produced in accordance with Example 1, a batch culture of approximately 1 liter working volume was conducted to assess microbial bio-production of 3-HP.

*E. coli* DF40+pKK223+MCR was inoculated from freezer stocks by standard practice (Sambrook and Russell, 2001) into a 50 mL baffled flask of LB media plus 200 µg/mL ampicillin where indicated and grown to stationary phase overnight at 37° C. with shaking at 225 rpm. In the morning, this culture was used to inoculate (5% v/v) a 1-L bioreactor vessel comprising M9 minimal media plus 5% (w/v) glucose plus 200 µg/mL ampicillin, plus 1 mM IPTG, where indicated. The bioreactor vessel was maintained at pH 6.75 by addition of 10 M NaOH or 1 M HCl, as appropriate. The dissolved oxygen content of the bioreactor vessel was maintained at 80% of saturation by continuous sparging of air at a rate of 5 L/min and by continuous adjustment of the agitation rate of the bioreactor vessel between 100 and 1000 rpm. These bio-production evaluations were conducted in at least triplicate. To monitor growth of these cultures, optical density measurements (absorbance at 600 nm, 1 cm path length), which correlates to cell number, were taken at the time of inoculation and every 2 hrs after inoculation for the first 12 hours. On day 2 of the bio-production event, samples for optical density and other measurements were collected every 3 hours. For each sample collected, cells were pelleted by centrifugation and the supernatant was collected for analysis of 3-HP production as described per "Analysis of cultures for 3-HP production" in the Common Methods section. Preliminary final titer of 3-HP in this 1-liter bio-production volume was calculated based on HPLC analysis to be 0.7 g/L 3-HP. It is acknowledged that there is likely co-production of malonate semialdehyde, or possibly another aldehyde, or possibly degradation products of malonate semialdehyde or other aldehydes, that are indistinguishable from 3-HP by this HPLC analysis.

Example 42

Tolerance Plus Bio-Production Pathway (Prophetic Example)

Using methods known to those skilled in the art, including those provided in the Common Methods Section, and also using specific methods from the other examples herein as to making and incorporating nucleic acid sequences to provide increased 3-HP tolerance and to provide 3-HP bio-production, genetic modifications are made to a selected microorganism to provide heterologous nucleic acid sequences that increase both 3-HP tolerance and 3-HP production above levels found in the non-modified microorganism. A plasmid or other vector or a DNA sequence (for direct incorporation) is constructed that comprises one or more nucleic acid sequences that encode for enzyme(s) or other polypeptide(s) that, when combined into and expressed in the selected microorganism, increase(s) tolerance to 3-HP by modifying one or more aspects of the 3HPTGC. That or a different plasmid or other vector or a DNA sequence (for direct incorporation) is constructed to comprise one or more nucleic acid sequences that encode for enzyme(s) or other polypeptide(s) that, when expressed in the selected microorganism, provide for (or increase) 3-HP bio-production.

In the case of plasmids, the plasmid(s) is/are contacted with the selected microorganism under suitable conditions to promote transformation, and transformed microorganisms are selected for and identified. In the case of other vectors or the DNA sequence(s), these are introduced to the selected microorganism by methods well-known to those skilled in the art. Selection for transformed recombinant microorganisms likewise may be conducted according to methods well-known to those skilled in the art.

A first particular resultant recombinant microorganism comprises enhanced 3-HP tolerance and bio-production capabilities compared to the control, non-tolerance-modified microorganism, in which 3-HP tolerance is at least 20 percent greater than tolerance of the non-tolerance-modified control and 3-HP bio-production is at least 20 percent greater than 3-HP bio-production of the non-tolerance-modified control. 3-HP tolerance is assessed by a 24-hour Minimum Inhibitory Concentration (MIC) evaluation based on the MIC protocol provided in the Common Methods Section. 3-HP bio-production is based on a batch culture comparison lasting for at least 24 hours past lag phase, and final 3-HP titers are determined using the HPLC methods provided in the Common Methods Section.

Example 43

Demonstration of Suitable Metrics for Comparison of Tolerance Improvements

Growth rate data was determined for the following species under the specified conditions, aerobic and anaerobic, across a range of 3-HP concentrations in the cell cultures. This demonstrates methods that may be used to assess differences between a control and a treatment microorganism. These or other methods may be used to demonstrate tolerance differences for various embodiments of the present invention.

As shown in the accompanying figures, FIGS. 15A-O, the data may be evaluated and presented in a number of ways: a "toleragram" (showing growth rates at different 3-HP concentrations); change in optical density over the evaluation period; and number of cell doublings over the evaluation period.

These are provided to indicate non-limiting methodologies and approaches to assessing changes in tolerance, including microorganism and culture system tolerance, in addition to the use of MIC evaluations.

The following methods were used to generate the data in the noted figures.

E. coli Aerobic

Overnight cultures of wild-type E. coli BW25113 were grown in triplicate in 5 mL standard LB medium. 100 uL of overnight cultures were used to inoculate triplicate 5 mL samples of M9 minimal medium+3HP, containing 47.7 mM $Na_2HPO_4$, 22 mM $KH_2PO_4$, 8.6 mM NaCl, 18.7 mM $NH_4Cl$, 2 mM $MgSO_4$, 0.1 mM $CaCl_2$, and 0.4% glucose, with 3HP concentrations ranging from 0-50 g/L. Starting $OD_{600}$ ranged from 0.02-0.08. Cultures were incubated at 37 C for about 24 hours, and $OD_{600}$ was recorded every 1-2 hours for the first 8 hours with a final $OD_{600}$ recorded at about 24 hours. Maximum specific growth rates ($\mu_{max}$) were calculated by determining the optimal fit of exponential trend lines with OD data for the evaluation period. Specific changes in $OD_{600}$ over approximately 24 hours ($\Delta_{24hr}OD_{600}$) were calculated as the difference in t=24 hr and t=0 optical density, $\Delta_{24hr}OD_{600}=(OD_{t=24})-(OD_{t=0})$. Specific number of doublings ($N_d$) were calculated by solving for N in the equation $2^N=(OD_{t=24})/(OD_{t=0})$.

E. coli Anaerobic

Overnight cultures of wild-type E. coli BW25113 were grown in triplicate in 5 mL standard LB medium. 100 uL of overnight cultures were used to inoculate triplicate 5 mL samples of M9 minimal medium+3HP, containing 47.7 mM $Na_2HPO_4$, 22 mM $KH_2PO_4$, 8.6 mM NaCl, 18.7 mM $NH_4Cl$, 2 mM $MgSO_4$, 0.1 mM $CaCl_2$, and 0.4% glucose, with 3HP concentrations ranging from 0-50 g/L. Starting $OD_{600}$ ranged from 0.02-0.08. Cultures were sparged with $CO_2$ for 10 seconds, sealed, and incubated at 37 C for about 24 hours. $OD_{600}$ was recorded every 1-2 hours during the first 8 hours with a final $OD_{600}$ recorded at about 24 hours. For each data point the sample was opened, sampled, re-sparged with $CO_2$, and sealed once again. Maximum specific growth rates ($\mu_{max}$) were calculated by determining the optimal fit of exponential trend lines with OD data for the evaluation period. Specific changes in $OD_{600}$ over approximately 24 hours ($\Delta_{24hr}OD_{600}$) were calculated as the difference in t=24 hr and t=0 optical density, $\Delta_{24hr}OD_{600}=(OD_{t=24})-(OD_{t=0})$. Specific number of doublings ($N_d$) were calculated by solving for N in the equation $2^N=(OD_{t=24})/(OD_{t=0})$.

Bacillus Subtilis Aerobic

Overnight cultures of wild-type B. Subtilis were grown in triplicate in 5 mL standard LB medium. 100 uL of overnight cultures were used to inoculate triplicate 5 mL samples of M9 minimal medium+3HP+glutamate supplementation, containing 47.7 mM $Na_2HPO_4$, 22 mM $KH_2PO_4$, 8.6 mM NaCl, 18.7 mM $NH_4Cl$, 2 mM $MgSO_4$, 0.1 mM $CaCl_2$, 0.4% glucose, and 10 mM glutamate, with 3HP concentrations ranging from 0-50 g/L. Starting $OD_{600}$ ranged from 0.02-0.08. Cultures were incubated at 37 C for about 24 hours, and $OD_{600}$ was recorded every 1-2 hours for the first 8 hours with a final $OD_{600}$ recorded at about 24 hours. Maximum specific growth rates ($\mu_{max}$) were calculated by determining the optimal fit of exponential trend lines with OD data for the evaluation period. Specific changes in $OD_{600}$ over approximately 24 hours ($\Delta_{24hr}OD_{600}$) were calculated as the difference in t=24 hr and t=0 optical density, $\Delta_{24hr}OD_{600}=(OD_{t=24})-(OD_{t=0})$. Specific number of doublings ($N_d$) were calculated by solving for N in the equation $2^N=(OD_{t=24})/(OD_{t=0})$.

S. cerevisiae Aerobic

Overnight cultures of S. cerevisiae were grown in triplicate in 5 mL standard YPD medium containing 10 g/L yeast extract, 20 g/L peptone, and 2% glucose. 100 uL of overnight cultures were used to inoculate triplicate 5 mL samples of SD minimal medium (without vitamins)+3HP, containing 37.8 mM $(NH_4)_2SO_4$, 8.1 uM $H_3BO_3$, 0.25 uM $CuSO_4$, 0.6 uM KI, 1.25 uM $FeCl_3$, 2.65 uM $MnSO_4$, 1 uM $Na_2MoO_4$, 2.5 uM $ZnSO_4$, 6.25 mM $KH_2PO_4$, 0.86 mM $K_2HPO_4$, 4.15 mM $MgSO_4$, 1.71 mM NaCl, 0.90 mM $CaCl_2$, and 2% glucose, with 3HP concentrations ranging from 0-50 g/L. Starting $OD_{600}$ ranged from 0.03-0.08. Cultures were sparged with $CO_2$ for 10 seconds, sealed, and incubated at 30 C for about 24 hours. $OD_{600}$ was recorded every 1-2 hours for the first 8-12 hours with a final $OD_{600}$ recorded at about 24 hours. Maximum specific growth rates ($\mu_{max}$) were calculated by determining the optimal fit of exponential trend lines with OD data for the evaluation period. Specific changes in $OD_{600}$ over approximately 24 hours ($\Delta_{24hr}OD_{600}$) were calculated as the difference in t=24 hr and t=0 optical density, $\Delta_{24hr}OD_{600}=(OD_{t=24})-(OD_{t=0})$. Specific number of doublings ($N_d$) were calculated by solving for N in the equation $2^N=(OD_{t=24})/(OD_{t=0})$.

S. cerevisiae Anaerobic

Overnight cultures of S. cerevisiae were grown in triplicate in 5 mL standard YPD medium containing 10 g/L yeast extract, 20 g/L peptone, and 2% glucose. 100 uL of overnight cultures were used to inoculate triplicate 5 mL samples of SD minimal medium (without vitamins)+3HP, containing 37.8 mM $(NH_4)_2SO_4$, 8.1 uM $H_3BO_3$, 0.25 uM $CuSO_4$, 0.6 uM KI, 1.25 uM $FeCl_3$, 2.65 uM $MnSO_4$, 1 uM $Na_2MoO_4$, 2.5 uM $ZnSO_4$, 6.25 mM $KH_2PO_4$, 0.86 mM $K_2HPO_4$, 4.15 mM $MgSO_4$, 1.71 mM NaCl, 0.90 mM $CaCl_2$, and 2% glucose, with 3HP concentrations ranging from 0-50 g/L. Starting $OD_{600}$ ranged from 0.03-0.08. Cultures were sparged with $CO_2$ for 10 seconds, sealed, and incubated at 30 C for about 24 hours. $OD_{600}$ was recorded every 1-2 hours for the first 8-12 hours with a final $OD_{600}$ recorded at about 24 hours. For each data point the sample was opened, sampled, re-sparged with $CO_2$, and sealed once again. Maximum specific growth rates ($\mu_{max}$) were calculated by determining the optimal fit of exponential trend lines with OD data for the evaluation period. Specific changes in $OD_{600}$ over approximately 24 hours ($\Delta_{24hr}OD_{600}$) were calculated as the difference in t=24 hr and t=0 optical density, $\Delta_{24hr}OD_{600}=(OD_{t=24})-(OD_{t=0})$. Specific number of doublings ($N_d$) were calculated by solving for N in the equation $2^N=(OD_{t=24})/(OD_{t=0})$.

Example 44

Genetic Modification by Introduction of Genes Identified as Able to Increase Microorganism Tolerance to 3-HP Genetic elements containing one to several genes have been identified by the SCALES 3-HP tolerance data as important to 3-HP tolerance. In order to develop an optimal combination of these elements suitable to imparting greater tolerance on an organism, a number of these genetic elements have been cloned into a series of compatible plasmids containing different origins of replication and selection markers. As such, combinations of these compatible plasmids can be transformed into cell lines in order to assess a combinatorial affect on 3-HP tolerance. The parent plasmid vectors containing the different origins of replication and selection markers are identified in the following table, which provides SEQ ID numbers (SEQ ID NOs:005-012 and 183-186) for each such parent plasmid vectors. These plasmids were used to construct the plasmids described herein, and these plasmids, without insert, were also used for constructing control cell lines for tolerance MIC testing.

TABLE 41

| Vector | Sequence |
|---|---|
| pSMART-HC-Amp | SEQ ID. 005 |
| pSMART-LC-Kan | SEQ ID. 006 |
| pBT-3 | SEQ ID. 007 |
| pKK223-3 | SEQ ID. 008 |
| pACYC177 (kan only) | SEQ ID. 009 |
| pWH1520 | SEQ ID. 010 |
| pHT08 | SEQ ID. 011 |

TABLE 41-continued

| Vector | Sequence |
|---|---|
| pJ61:25125 | SEQ ID. 012 |
| pYes2.1-topo | SEQ ID. 183 |
| pRS423 | SEQ ID. 184 |
| pRS425 | SEQ ID. 185 |
| pJ251 | SEQ ID. 186 |

Method A: Plasmid Design and Construction of Toleragenic Genetic Elements by Gene Synthesis A single plasmid comprising a number of identified genetic elements was constructed in a manner that a plurality of other plasmids could easily be constructed (some of which were constructed as described). These operons, including a constitutive E. coli promoter, ribosome binding sites, and open region frames of these genetic elements, were combined in the single plasmid, which was produced by the gene synthesis services of DNA2.0 (Menlo Park, Calif. USA), a commercial DNA gene synthesis provider. Each of the open reading frames for producing proteins was codon optimized according to the services of DNA2.0. Additionally, restriction sites were incorporated between each operon and gene to generate plasmids capable of expressing all combinations of these proteins through a series of restriction digests and self ligation. Other features of this constructs include an rrnB terminator sequence after the final operons and mosaic ends containing AfeI restriction sites flanking each end of the coding region for use with a EZ::TN™ Transposon system obtained from EPICENTRE (Madison, Wis.) for future genomic incorporation of these elements into strains. This constructed plasmid was provided in a pJ61 vector backbone. The sequence of the resulting vector, termed pJ61:25135, is provided as SEQ ID NO:012.

By the method described herein various nucleic acid sequences encoding enzymes that catalyze enzymatic conversion steps of the 3HPTGC were introduced into the pJ61:25135 plasmid. As shown in the following table, the pJ61:25135 plasmid was variously modified to contain gene optimized sequences for CynS and CynT expressed under a modified Ptrc promoter located between PmlI and SfoI restriction sites, AroG expressed under a PtpiA promoter located between SfoI and SmaI restriction sites (SEQ ID NO:013), SpeD, SpeE, and SpeF expressed under a modified Ptrc promoter located between SmaI and ZraI restriction sites (SEQ ID NO:014), ThrA expressed under a PtaIA promoter located between ZraI and HpaI restriction sites (SEQ ID NO:015), Asd expressed under a PrpiA promoter located between HpaI and PmeI restriction sites (SEQ ID NO:016), CysM expressed under a Ppgk promoter located between PmeI and ScaI restriction sites (SEQ ID NO:017), IroK expressed under a PtpiA promoter located between ScaI and NaeI restriction sites, and IlvA expressed under a PtaIA promoter located between NaeI and EcoICRI restriction sites (SEQ ID NO:018). Each of these restriction sites is unique within the pJ61:25135 plasmid.

TABLE 42

E. coli Tolerance Plasmid Construction

| Gene(s) or Region Name | Vector | Cloning Method | Primer A | Primer B | PCR Sequence or Codon Optimized Sequence (Region) | Plasmid Name |
|---|---|---|---|---|---|---|
| aroG | pJ61 | A | N/A | N/A | SEQ ID 0013 | pJ61-aroG |
| speFED | pJ61 | A | N/A | N/A | SEQ ID 0014 | pJ61-speFED |

TABLE 42-continued

E. coli Tolerance Plasmid Construction

| Gene(s) or Region Name | Vector | Cloning Method | Primer A | Primer B | PCR Sequence or Codon Optimized Sequence (Region) | Plasmid Name |
|---|---|---|---|---|---|---|
| thrA | pJ61 | A | N/A | N/A | SEQ ID 0015 | pJ61-thrA |
| Asd | pJ61 | A | N/A | N/A | SEQ ID 0016 | pJ61-asd |
| cysM | pJ61 | A | N/A | N/A | SEQ ID 0017 | pJ61-cysM |
| ilvA | pJ61 | A | N/A | N/A | SEQ ID 0018 | pJ61-ilvA |
| aroH | pKK223 | B | N/A | N/A | N/A | pKK223-aroH |
| aroH G149C | pKK223 | B | N/A | N/A | N/A | pKK223-aroH*445 |
| aroH G149D | pKK223 | B | N/A | N/A | N/A | pKK223-aroH*447 |
| aroH P18L | pKK223 | B | N/A | N/A | N/A | pKK223-aroH*457 |
| metE C645A | pKK223 | B | N/A | N/A | N/A | pKK223-metE C645A |
| thrA | pKK223 | B | N/A | N/A | SEQ ID 0019 | pKK223-thrA |
| cynTS | pSMART-LC-Kan | B | N/A | N/A | SEQ ID 0020 | pSmart-LC-Kan-cynTS |
| folA C1 | pSMART-LC-KAN | C | SEQ ID 0021 | SEQ ID 0022 | SEQ ID 0023 | pSmart-LC-Kan-folA-C1 |
| folA ORF | pSMART-LC-KAN | C | SEQ ID 0024 | SEQ ID 0025 | SEQ ID 0026 | pSmart-LC-Kan-folA-ORF |
| folD | pSMART-LC-KAN | C | SEQ ID 0027 | SEQ ID 0028 | SEQ ID 0029 | pSmart-LC-Kan-folD |
| aroKB C1 | pSMART-LC-KAN | C | SEQ ID 0030 | SEQ ID 0031 | SEQ ID 0032 | pSmart-LC-Kan-aroKB C1 |
| pheA C1 | pSMART-LC-KAN | C | SEQ ID 0033 | SEQ ID 0034 | SEQ ID 0035 | pSmart-LC-Kan-pheA C1 |
| pheA C2 | pSMART-LC-KAN | C | SEQ ID 0036 | SEQ ID 0037 | SEQ ID 0038 | pSmart-LC-Kan-pheA C2 |
| menA C1 | pSMART-LC-KAN | C | SEQ ID 0039 | SEQ ID 0040 | SEQ ID 0041 | pSmart-LC-Kan-menA C1 |
| menA ORF | pSMART-LC-KAN | C | SEQ ID 0042 | SEQ ID 0043 | SEQ ID 0044 | pSmart-LC-Kan-menA ORF |
| serA | pSMART-LC-KAN | C | SEQ ID 0045 | SEQ ID 0046 | SEQ ID 0047 | pSmart-LC-Kan-serA |
| glyA C1 | pSMART-LC-KAN | C | SEQ ID 0048 | SEQ ID 0049 | SEQ ID 0050 | pSmart-LC-Kan-glyA C1 |
| glyA ORF | pSMART-LC-KAN | C | SEQ ID 0051 | SEQ ID 0052 | SEQ ID 0053 | pSmart-LC-Kan-glyA ORF |
| metC C1 | pSMART-LC-KAN | C | SEQ ID 0054 | SEQ ID 0055 | SEQ ID 0056 | pSMART-LC-KAN-metC C1 |
| tyrA | pSMART-LC-KAN | C | SEQ ID 0057 | SEQ ID 0058 | SEQ ID 0059 | pSmart-LC-Kan-tyrA |
| tyrA-aroF | pSMART-LC-KAN | C | SEQ ID 0060 | SEQ ID 0061 | SEQ ID 0062 | pSmart-LC-Kan-tyrA-aroF |
| aroE | pSMART-LC-KAN | C | SEQ ID 0063 | SEQ ID 0064 | SEQ ID 0065 | pSmart-LC-Kan-aroE |
| ilvA | pSMART-LC-KAN | C | SEQ ID 0066 | SEQ ID 0067 | SEQ ID 0068 | pSmart-LC-KAN-ilvA C1 |
| ilvA | pSMART-LC-KAN | C | SEQ ID 0069 | SEQ ID 0070 | SEQ ID 0071 | pSmart-LC-KAN-ilvA operon |
| cysM | pSMART-LC-KAN | C | SEQ ID 0072 | SEQ ID 0073 | SEQ ID 0074 | pSmart-LC-Kan-cysM |
| cynTS | pSMART-HC-AMP | D | SEQ ID 0075 | SEQ ID 0076 | SEQ ID 0077 | pSmart-HC-Amp-cynTS |
| metC | pSMART-HC-Amp | D | SEQ ID 0078 | SEQ ID 0079 | SEQ ID 0080 | pSmart-HC-Amp-metC |
| dapA | pSMART-HC-Amp | E | SEQ ID 0081* | SEQ ID 0082* | SEQ ID 0083 | pSmart-HC-Amp-dapA |
| cadA | pSMART-HC-Amp | E | SEQ ID 0084* | SEQ ID 0085* | SEQ ID 0086 | pSmart-HC-Amp-cadA |
| prs | pSMART-HC-Amp | E | SEQ ID 0087* | SEQ ID 0088* | SEQ ID 0089 | pSmart-HC-Amp-prs |
| nrdAB | pSMART-HC-Amp | E | SEQ ID 0090* | SEQ ID 0091* | SEQ ID 0092 | pSmart-HC-Amp-nrdAB |
| nrdLEF | pSMART-HC-Amp | E | SEQ ID 0093* | SEQ ID 0094* | SEQ ID 0095 | pSmart-HC-Amp-nrdLEF |
| lysA | pSMART-HC-Amp | E | SEQ ID 0096* | SEQ ID 0097* | SEQ ID 0098 | pSMART-HC-Amp-lysA |

TABLE 42-continued

E. coli Tolerance Plasmid Construction

| Gene(s) or Region Name | Vector | Cloning Method | Primer A | Primer B | PCR Sequence or Codon Optimized Sequence (Region) | Plasmid Name |
|---|---|---|---|---|---|---|
| cyntTS | pACYC177 (kan only) | F | SEQ ID 0099 | SEQ ID 0100 | SEQ ID 0101 | pACYC177-cynTS |
| aroH G149C | pACYC177 (kan only) | F | SEQ ID 0102 | SEQ ID 0103 | SEQ ID 0104 | pACYC177-aroH* |
| speB | pACYC177 (kan only) | F | SEQ ID 0105 | SEQ ID 0106 | SEQ ID 0107 | pACYC177-speB |
| metE C645A | pACYC177 (kan only) | F | SEQ ID 0108 | SEQ ID 0109 | SEQ ID 0110 | pACYC177-metE* |
| metC | pACYC177 (kan only) | F | SEQ ID 0111 | SEQ ID 0112 | SEQ ID 0113 | pACYC177-metC |
| cyntTS | pBT-3 | G | SEQ ID 0114 | SEQ ID 0115 | SEQ ID 0116 | pBT-3-cynTS |
| aroH G149C | pBT-3 | G | SEQ ID 0117 | SEQ ID 0118 | SEQ ID 0119 | pBT-3-aroH* |
| speB | pBT-3 | G | SEQ ID 0120 | SEQ ID 0121 | SEQ ID 0122 | pBT-3-speB |

*5'phosphorylated

To create a set of plasmids containing each of these single operons, a series of restrictions and self-ligations are performed. As such, any operons can be isolated by removal of the DNA sequences between its flanking restriction sites and the EcoICRI and PmlI sites flanking the entire protein coding region of the plasmid. For example, the plasmid comprising the operon comprising the AroG polypeptide, expressed under a PtpiA promoter and located between SfoI and SmaI restriction sites, was created by first digesting the pJ61:25135 plasmid with PmlI and SfoI obtained from New England BioLabs (Ipswich, Mass. USA) according to manufacturer's instructions. The resulting DNA was then self-ligated with T4 DNA ligase obtained from New England BioLabs (Ipswich, Mass. USA) according to manufacturer's instructions, and transformed into E. coli K12. Individual colonies from this E. coli K12 transformation were grown in liquid culture and plasmids from individual colonies were isolated using a Qiagen Miniprep kit (Valencia, Calif. USA) according to manufacturer's instructions, The isolated plasmids were screened by restriction digests with AfeI, and correct plasmids were carried on the next round of restriction and self ligation. In the second round, these plasmids were subjected to restriction with SmaI and EcoICRI obtained from New England BioLabs (Ipswich, Mass. USA) and Promega Corporation (Madison, Wis.), respectively, according to manufacturer's instructions. The resulting DNA was then self-ligated with T4 DNA ligase obtained from New England BioLabs (Ipswich, Mass. USA) according to manufacturer's instructions, and transformed into E. coli K12. Individual colonies from this E. coli K12 transformation were grown in liquid culture and plasmids from individual colonies were isolated using a Qiagen Miniprep kit (Valencia, Calif. USA) according to manufacturer's instructions, The isolated plasmids were screened by restriction digests with AfeI, and verified by sequencing.

In a similar manner using the corresponding restriction sites listed above the following plasmids were created: pJ61-IlvA expressed under a PtaIA promoter located between NaeI and EcoICRI restriction sites; pJ61-CysM expressed under a Ppgk promoter located between PmeI and ScaI restriction sites; pJ61-Asd expressed under a PrpiA promoter located between HpaI and PmeI restriction sites; pJ61-ThrA expressed under a PtaIA promoter located between ZraI and HpaI restriction sites; pJ61-SpeDEF expressed under a Ptrc promoter located between SmaI and ZraI restriction sites; pJ61-AroG expressed under a PtpiA promoter located between SfoI and SmaI restriction sites; and pJ61-CynTS expressed under a Ptrc promoter located between PmlI and SfoI restriction sites. Likewise, any combination of these operons can be obtained via a similar restriction and self-ligation scheme.

These sequence-verified plasmids were transformed into BW25113 E. coli cells as tested for tolerance to 3-HP. In addition, these plasmids can be restricted with AfeI and the purified piece containing the individual operons with mosaic ends can be incorporated into the genome of a cell line using the EZ::TN™ Transposon system obtained from EPICENTRE (Madison, Wis.) using the manufactures instructions. Likewise, these operons can be moved to any variety of plasmids from providing additional control of expression or for propagation in a variety of strains or organisms.

Method B: Plasmid Containing Identified Elements Received from Other Labs

After development of the map of the 3HPTGC, a literature review identified previous work on several of the identified genes. Requests were made to the laboratories that made these reports for plasmids containing either the wild-type or mutated genes for the elements identified in the 3HPTGC. The so-obtained gene and the proteins they encode are identified by sequence numbers.

Plasmids containing the wild-type aroH gene and aroH mutants were kindly provided as a gift from the Bauerle laboratory at the University of Virginia. These mutants were described in Ray J M, Yanofsky C, Bauerle R., J. Bacteriol. 1988 December; 170(12):5500-6. Mutational analysis of the catalytic and feedback sites of the tryptophan-sensitive 3-deoxy-D-arabino-heptulosonate-7-phosphate synthase of Escherichia coli. Along with a pKK223 plasmid containing the wild-type gene, three additional pKK223 plasmids were provided containing mutated genes coding for a glycine to cysteine mutation at position 149, a glycine to aspartic acid mutation at position 149, and a proline to leucine mutation at position 18.

A plasmid containing a mutant metE gene was kindly provided as a gift from the Matthews laboratory at the University of Michigan. This mutant was described in Hondorp E R, Matthews R G. J. Bacteriol. 2009 May; 191(10):3407-10. Epub 2009 Mar. 13. Oxidation of cysteine 645 of cobalamin-independent methionine synthase causes a methionine limitation in *Escherichia coli*. This pKK233 plasmid carries a metE gene coding for a mutation of a cysteine to an alanine at position 645.

The sequences for the encoded proteins for these genes are provided as SEQ ID NOs: 022 to 026.

Method C: Tolerance Plasmids Construction in a pSMART-LC-Kan Vector

Several of the genetic elements that were assessed for their affects on 3-HP tolerance were constructed in a pSMART-LC-kan vector (SEQ ID NO:027) obtained from Lucigen Corporation (Middleton Wis., USA). This vector provides a low copy replication origin and kanamycin selection. All of these plasmids were created in a similar method and the introduced genetic elements and the proteins they encode are identified by sequence numbers in Table 42 under the method C section therein. Each row in Table 42, under method C, contains the respective sequence information for the protein contained within the cloned plasmid, the primers used in any polymerase chain reactions, and the sequence of the polymerase chain reaction product used to create the new plasmid.

In each case, an identical procedure was used to create the final plasmid. The primers listed were used to amplify the correct insert using pfx DNA polymerase from Invitrogen Corporation (Carlsbad, Calif. USA) and genomic *E. coli* K12 DNA as template using the manufacturer's instructions. The 5' termini or the amplified DNA product were phosphorylated using T4 polynucleotide kinase for New England Biolabs (Ipswich, Mass. USA) using the manufacturer's instructions. The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). The extracted phosphorylated DNA was then blunt-end ligated into the pSMART-LC-Kan vector and transformed into 10G *E. coli* cells using the manufacturer's instructions. Transformed cells were allowed to recover in rich media and then were plated on to LB agar plated containing kanamycin for proper selection. After colony growth, single colonies were grown in LB media and plasmid DNA was extracted using miniprep kits obtained from Qiagen Corporation (Valencia, Calif. USA). The isolated plasmid DNA was checked by restriction digest and sequenced verified before use in other experiments.

Method D: Tolerance Plasmids Construction in a pSMART-HC-Amp Vector

Several of the genetic elements that were assessed for their affects on 3-HP tolerance were constructed in a pSMART-HC-AMP vector obtained from Lucigen Corporation (Middleton Wis., USA). This vector provides a high copy replication origin and ampicillin selection. All of these plasmids were created in a similar method and are identified as method D in table 42. Each row in Table 42 contains the sequence information for the protein contained within the cloned plasmid, the primers used in any polymerase chain reactions, and the sequence of the polymerase chain reaction product used to create the new plasmid.

In each case, an identical procedure was used to create the final plasmid. The primers listed were used to amplify the correct insert using KOD DNA polymerase from EMD Chemical Corporation (Gibbstown, N.J. USA) and the pKK223 plasmids for each corresponding gene or genetic elements created with method B of Table 42 as template using the manufacturer's instructions. The 5' termini of the amplified DNA product were phosphorylated using T4 polynucleotide kinase for New England Biolabs (Ipswich, Mass. USA) using the manufacturer's instructions. The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). The extracted phosphorylated DNA was then blunt-end ligated into the pSMART-HC-AMP vector and transformed into 10G *E. coli* cells using the manufacturer's instructions. Transformed cells were allowed to recover in rich media and then were plated on to LB agar plated containing ampicillin for proper selection. After colony growth, single colonies were grown in LB media and plasmid DNA was extracted using miniprep kits obtained from Qiagen Corporation (Valencia, Calif. USA). The isolated plasmid DNA was checked by restriction digest and sequenced verified before use in other experiments.

Method E: Additional Tolerance Plasmids Construction in a pSMART-HC-Amp Vector

Several of the genetic elements that were assessed for their affects on 3-HP tolerance were constructed in a pSMART-HC-AMP vector obtained from Lucigen Corporation (Middleton Wis., USA). This vector provides a high copy replication origin and ampicillin selection. All of these plasmids were created in a similar method and are identified as method E in Table 42. Each row in Table 42 contains the sequence information for the protein contained within the cloned plasmid, the primers used in any polymerase chain reactions, and the sequence of the polymerase chain reaction product used to create the new plasmid.

In each case, an identical procedure was used to create the final plasmid. The primers listed were used to amplify the correct insert using KOD DNA polymerase from EMD Chemical Corporation (Gibbstown, N.J. USA) and genomic *E. coli* K12 DNA as template using the manufacturer's instructions. Since the 5' termini of the primers were already phosphorylated, no other treatment was needed for the amplified product. The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). The extracted phosphorylated DNA was then blunt-end ligated into the pSMART-HC-Amp vector and transformed into 10G *E. coli* cells using the manufacturer's instructions. Transformed cells were allowed to recover in rich media and then were plated on to LB agar plated containing ampicillin for proper selection. After colony growth, single colonies were grown in LB media and plasmid DNA was extracted using miniprep kits obtained from Qiagen Corporation (Valencia, Calif. USA). The isolated plasmid DNA was checked by restriction digest and sequenced verified before use in other experiments.

Method F: Tolerance Plasmids Construction in a pACYC177 (Kan Only) Vector

Several of the genetic elements that were assessed for their affects on 3-HP tolerance were constructed in a pACYC177 (Kan only) vector. This backbone was created by amplifying a portion of the pACYC177 plasmid using the primer CPM0075 (5'-CGCGGTATCATTGCAGCAC-3') (SEQ ID NO:123) and primer CPM0018 (5'-GCATCGGCTCTTC-CGCGTCAAGTCAGCGTAA-3') (SEQ ID NO:124) using KOD polymerase from EMD Chemical Corporation (Gibbstown, N.J. USA). The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). This DNA was designated pACYC177 (Kan only) and was kept for ligation to the products created herein. This pACYC177 (Kan only) backbone DNA provides low copy replication origin and kanamycin selection. All of these plasmids were created in a similar method and are identified as method F in Table 42. Each row in Table 42 contains the sequence information for the protein contained within the cloned plasmid, the primers used in any polymerase chain reactions, and the sequence of the polymerase chain reaction product used to create the new plasmid.

In each case, an identical procedure was used to create the final plasmid. The primers listed were used to amplify the correct insert using KOD DNA polymerase from EMD Chemical Corporation (Gibbstown, N.J. USA) using the manufacturer's instructions with either the pKK223 plasmids for each corresponding gene (or genetic element) created with method B of Table 42 or with genomic E. coli DNA as template. The 5' termini or the amplified DNA product were phosphorylated using T4 polynucleotide kinase for New England Biolabs (Ipswich, Mass. USA) using the manufacturer's instructions. The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). The extracted phosphorylated DNA was then blunt-end ligated to the pACYC177 (Kan only) backbone DNA described herein and transformed into 10G E. coli cells using the manufacturer's instructions. Transformed cells were allowed to recover in rich media and then were plated on to LB agar plated containing kanamycin for proper selection. After colony growth, single colonies were grown in LB media and plasmid DNA was extracted using miniprep kits obtained from Qiagen Corporation (Valencia, Calif. USA). The isolated plasmid DNA was checked by restriction digest and sequenced verified before use in other experiments.

Method G: Tolerance Plasmids Construction in a pBT-3 Vector

Several of the genetic elements that were assessed for their affects on 3-HP tolerance were constructed in a pBT-3 vector. This backbone was created by amplifying a portion of the pBT-3 plasmid using the primer PBT-FOR (5'-AACGAAT-TCAAGCTTGATATC-3') (SEQ ID NO:125) and primer PBT-REV (5'-GAATTCGTTGACGAATTCTCTAG-3') (SEQ ID NO:126) using KOD polymerase from EMD Chemical Corporation (Gibbstown, N.J. USA). The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). This DNA was designated pBT-3 backbone and was kept for ligation to the products created herein. This pBT-3 backbone DNA provides low copy replication origin and chloramphenicol selection. All of these plasmids were created in a similar method and are identified as method G in Table 42. Each row in Table 42 contains the sequence information for the protein contained within the cloned plasmid, the primers used in any polymerase chain reactions, and the sequence of the polymerase chain reaction product used to create the new plasmid.

In each case, an identical procedure was used to create the final plasmid. The primers listed were used to amplify the correct insert using KOD DNA polymerase from EMD Chemical Corporation (Gibbstown, N.J. USA) using the manufacturer's instructions with either the pKK223 plasmids for each corresponding gene (or genetic element) created with method B of Table 42 or with genomic E. coli DNA as template. The 5' termini or the amplified DNA product were phosphorylated using T4 polynucleotide kinase for New England Biolabs (Ipswich, Mass. USA) using the manufacturer's instructions. The resulting product of this reaction was separated by agarose gel electrophoresis, and a band of the expected size was isolated by dissecting it from the gel and gel extracting the DNA using a gel extraction kit provided by Qiagen Corporation (Valencia, Calif. USA). The extracted phosphorylated DNA was then blunt-end ligated to the pBT-3 backbone DNA described herein and transformed into 10G E. coli cells using the manufacturer's instructions. Transformed cells were allowed to recover in rich media and then were plated on to LB agar plated containing chloramphenicol for proper selection. After colony growth, single colonies were grown in LB media and plasmid DNA was extracted using miniprep kits obtained from Qiagen Corporation (Valencia, Calif. USA). The isolated plasmid DNA was checked by restriction digest and sequenced verified before use in other experiments.

Example 45

Evaluation of a Novel Peptide Related to 3-HP Tolerance

A novel 21 amino acid peptide, termed IroK, has been discovered that increases 3-HP tolerance.

Methods: IroK Expression Studies

Primers including the entire IroK polypeptide region and RBS flanked by EcorI and HindIII restriction sites were obtained for expression studies (Operon, Huntsville, Ala.):

```
                                        (SEQ ID NO: 127)
(5'-AATTCGTGGAAGAAAGGGGAGATGAAGCCGGCATTACGCGATT
TCATCGCCATTGTGCAGGAACGTTTGGCAAGCGTAACGGCATAA-3',
```

```
                                        (SEQ ID NO: 128)
5'-AGCTTTATGCCGTTACGCTTGCCAAACGTTCCTGCACAATGGCGAT
GAAATCGCGTAATGCCGGCTTCATCTCCCCTTTCTTCCACG-3')
```

Primers including the IroK peptide region and RBS with a mutated start site (ATG to TTG) were used for the translational analysis:

```
                                        (SEQ ID NO: 187)
(5'-AATTCGTGGAAGAAAGGGGAGTTGAAGCCGGCATTACGCGATTTC
ATCGCCATTGTGCAGGAACGTTTGGCAAGCGTAACGGCATAA-3',
```

```
                                        (SEQ ID NO: 188)
5'-AGCTTTATGCCGTTACGCTTGCCAAACGTTCCTGCACAATGGCGA
TGAAATCGCGTAATGCCGGCTTCAACTCCCCTTTCTTCCACG-3')
```

The two oligonucleotides were added in a 1:1 ratio and annealed according to standard methodology in a thermal cycler. Ligation of the annealed primer product with the pKK223-3 expression vector (SEQ ID NO:008, Pharmacia, Piscataway, N.J.) was performed with T4 Ligase (Invitrogen, Carlsbad, Calif.) and incubated at 25° C. overnight. The ligation product was then electroporated into competent MACH1™-T1$^R$, plated on LB+ampicillan, and incubated at 37° C. for 24 hours. Plasmids were isolated and confirmed by purification and subsequent restriction digest and sequencing (Macrogen, Rockville, Md.). MICs were then determined corresponding to 1 mM IPTG induction.

Minimum Inhibitory Concentrations (MIC)

The minimum inhibitory concentration (MIC) was determined microaerobically in a 96 well-plate format. Overnight cultures of strains were grown in 5 mL LB (with antibiotic where appropriate). A 1% (v/v) inoculum was introduced into a 15 ml culture of MOPS minimal media. After the cells reached mid-exponential phase, the culture was diluted to an $OD_{600}$ of 0.200. The cells were further diluted 1:20 and a 10 µL aliquot was used to inoculate each well of a 96 well plate (~$10^4$ cells per well). The plate was arranged to measure the growth of variable strains or growth conditions in increasing 3-HP concentrations, 0 to 70 g/L, in 5 g/L increments. The minimum inhibitory 3-HP concentration and maximum 3-HP concentration corresponding to visible cell growth (OD~0.1) was recorded after 24 hours.

Results

Figure 20:
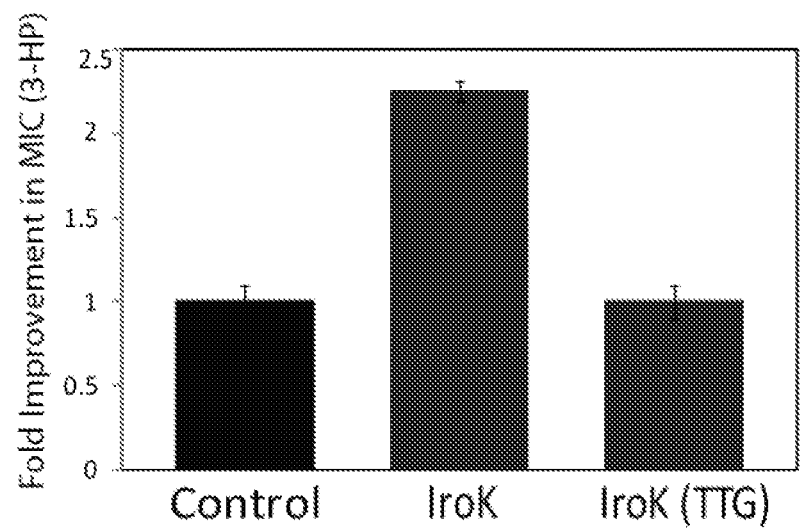
FIG. 20 provides a comparison regarding the IroK peptide sequence.
Figure 21:
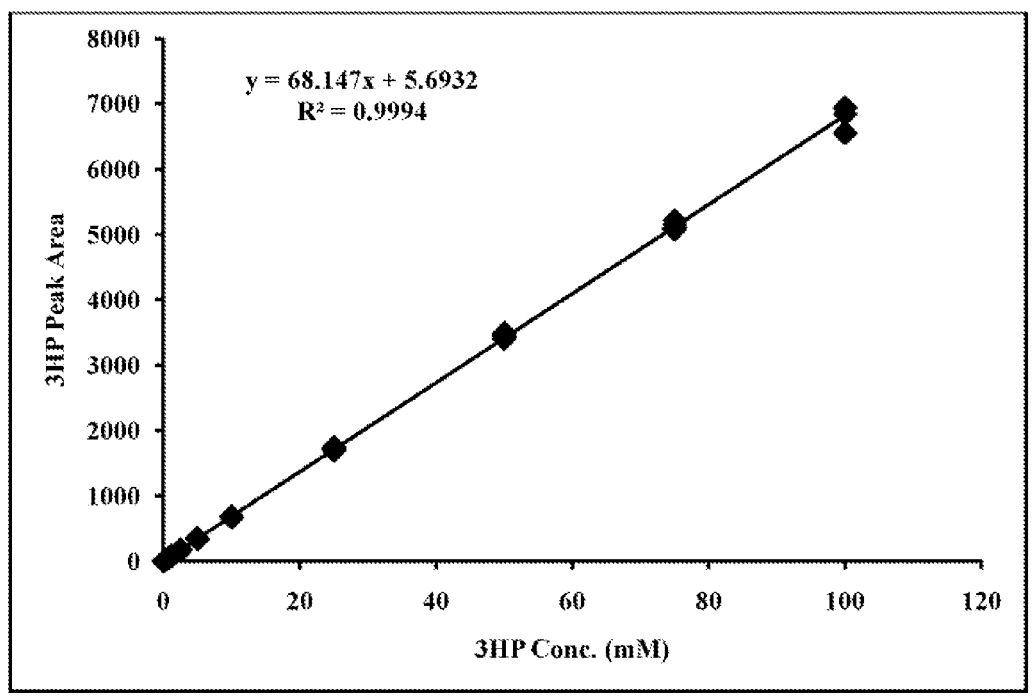
FIG. 21 provides a calibration curve for 3-HP conducted with HPLC.

To explore the effects of IroK, a peptide comprised of 21 amino acids (MKPALRDFIAIVQERLASVTA, SEQ ID NO:129), the sequence encoding for it along with the native predicted RBS was incorporated into an inducible expression vector (pKK223-3). FIG. 20 shows increased expression of the short 87 bp sequence which is sufficient to enhance tolerance to 3-HP (>2 fold increase in MIC). Additionally, the tolerance mechanism appears to be specific to 3-HP growth inhibition, as MICs remained unchanged for several other organic acids of similar molecular makeup including lactic, acrylic, and acetic acids. In an effort to dissect the mode of tolerance conferred, a nearly identical sequence was incorporated into the same vector with a single mutation in the translational start site (ATG to TTG), resulting in a decreased MIC equivalent to that of wild-type *E. coli* (FIG. 20). This result implies that the mechanism of tolerance is specific to the expression of the translated polypeptide rather than mapped to the DNA or RNA level.

A nucleic acid sequence encoding the IroK peptide, or suitable variants of it, may be provided to a microorganism, that may comprise one or more genetic modifications of the 3HPTGC to further increase 3-HP tolerance, and that also may have 3-HP production capability.

Example 46

Genetic Modification/Introduction of Malonyl-CoA Reductase for 3-HP Production in *E. coli* DF40

The nucleotide sequence for the malonyl-coA reductase gene from *Chloroflexus aurantiacus* was codon optimized for *E. coli* according to a service from DNA 2.0 (Menlo Park, Calif. USA), a commercial DNA gene synthesis provider. This gene sequence incorporated an EcoRI restriction site before the start codon and was followed by a HindIII restriction site. In addition a Shine Delgarno sequence (i.e., a ribosomal binding site) was placed in front of the start codon preceded by an EcoRI restriction site. This gene construct was synthesized by DNA 2.0 and provided in a pJ206 vector backbone. Plasmid DNA pJ206 containing the synthesized mcr gene was subjected to enzymatic restriction digestion with the enzymes EcoRI and HindIII obtained from New England BioLabs (Ipswich, Mass. USA) according to manufacturer's instructions. The digestion mixture was separated by agarose gel electrophoresis, and visualized under UV transillumination as described in Subsection II of the Common Methods Section. An agarose gel slice containing a DNA piece corresponding to the mcr gene was cut from the gel and the DNA recovered with a standard gel extraction protocol and components from Qiagen (Valencia, Calif. USA) according to manufacturer's instructions. An *E. coli* cloning strain bearing pKK223-aroH was obtained as a kind a gift from the laboratory of Prof. Ryan T. Gill from the University of Colorado at Boulder. Cultures of this strain bearing the plasmid were grown by standard methodologies and plasmid DNA was prepared by a commercial miniprep column from Qiagen (Valencia, Calif. USA) according to manufacturer's instructions. Plasmid DNA was digested with the restriction endonucleases EcoRI and HindIII obtained from New England Biolabs (Ipswich, Mass. USA) according to manufacturer's instructions. This digestion served to separate the aroH reading frame from the pKK223 backbone. The digestion mixture was separated by agarose gel electrophoresis, and visualized under UV transillumination as described in Subsection II of the Common Methods Section. An agarose gel slice containing a DNA piece corresponding to the backbone of the pKK223 plasmid was cut from the gel and the DNA recovered with a standard gel extraction protocol and components from Qiagen according to manufacturer's instructions.

Pieces of purified DNA corresponding to the mcr gene and pK223 vector backbone were ligated and the ligation product was transformed and electroporated according to manufacturer's instructions. The sequence of the resulting vector termed pKK223-mcr (SEQ ID NO:189) was confirmed by routine sequencing performed by the commercial service provided by Macrogen (USA). pKK223-mcr confers resistance to beta-lactamase and contains mcr gene under control of a Ptac promoter inducible in *E. coli* hosts by IPTG.

The expression clone pKK223-mcr and pKK223 control were transformed into both *E. coli* K12 and *E. coli* DF40 via standard methodologies. (Sambrook and Russell, 2001).

Example 47

Construction of *E. coli* Gene Deletion Strains

The following strains were obtained from the Keio collection: JW1650 (ΔpurR), JW2807 (ΔlysR), JW1316 (ΔtyrR), JW4356 (ΔtrpR), JW3909 (ΔmetJ), JW0403 (ΔnrdR). The Keio collection was obtained from Open Biosystems (Huntsville, Ala. USA 35806). Individual clones may be purchased from the Yale Genetic Stock Center (New Haven, Conn. USA 06520). These strains each contain a kanamycin marker in place of the deleted gene. For more information concerning the Keio Collection and the curing of the kanamycin cassette please refer to: Baba, T et al (2006). Construction of *Escherichia coli* K12 in-frame, single-gene knockout mutants: the Keio collection. *Molecular Systems Biology* doi:10.1038/msb4100050 and Datsenko K A and B L Wanner (2000). One-step inactivation of chromosomal genes in *Escherichia coli* K-12 using PCR products. *PNAS* 97, 6640-6645. These strains were made electro-competent by standard methodologies. Each strain was then transformed via standard electroporation methods with the plasmid pCP20, which was a kind gift from Dr. Ryan Gill (University of Colorado, Boulder, Colo. USA). Transformations were plated on Luria Broth agar plates containing 20 µg/mL chloramphenicol and 100 µg/mL ampicillin and incubated for 36 hours at 30 degrees Celsius. Clones were isolated from these transformation and grown overnight in 10 mL of M9 media lacking any antibiotics. Colonies were isolated from these cultures by streaking onto Luria Broth agar plates lacking any antibiotics. Colonies were confirmed to have lost the kanamycin marker as well as the plasmid pCP20 by confirming no growth on Luria broth agar plates containing the antibiotics, kanamycin (20 µg/mL), chloramphenicol (20 µg/mL) and ampicillin (100 µg/mL). Isolated clones were confirmed by colony PCR to have lost the kanamycin cassette. PCRs were carried out using Econo-Taq PLUS GREEN 2× master PCR mix, obtained from Lucigen, (Catalog #30033) (Middleton, Wis. USA). PCRs were carried out using a 96 well gradient ROBOcycler (Stratagene, La Jolla, Calif. USA 92037) with the following cycles: 1) 10 min at 95 degrees Celsius, 2) 30 of the following cycles, a) 1 min at 95 degrees Celsius, b) 1 min at 52 degrees Celsius, b) 2 min at 72 degrees Celsius, followed by 3) 1 cycle of 10 minutes at 72 degrees Celsius. The Primers used for the PCRs to confirm the removal of the kanamycin cassette for each of the clones are given in the following table. Primers were purchased from Integrated DNA Technologies (Coralville, Iowa USA). The resulting cured strains, called BX__00341.0, BX__00342.0, BX__00345.0, BX__00346.0, BX__00348.0 and BX__00349.0, correspond to JW1316 (ΔtyrR), JW4356 (ΔtrpR), JW3909 (ΔmetJ), JW1650 (ΔpurR), JW2807 (ΔlysR) and JW0403 (ΔnrdR) respectively.

TABLE 43

| Keio Clone Number | Gene Deletion | Forward Primer | Reverse Primer |
| --- | --- | --- | --- |
| JW1650 | purR | SEQ ID: 130 | SEQ ID: 131 |
| JW2807 | lysR | SEQ ID: 132 | SEQ ID: 133 |

TABLE 43-continued

| Keio Clone Number | Gene Deletion | Forward Primer | Reverse Primer |
| --- | --- | --- | --- |
| JW1316 | tyrR | SEQ ID: 134 | SEQ ID: 135 |
| JW4356 | trpR | SEQ ID: 136 | SEQ ID: 137 |
| JW3909 | metJ | SEQ ID: 138 | SEQ ID: 139 |
| JW0403 | nrdR | SEQ ID: 140 | SEQ ID: 141 |

Example 48

*E. coli* Strain Construction

According to the respective combinations in Tables 44 and 45, plasmids were introduced into the respective base strains. All plasmids were introduced at the same time via electroporation using standard methods. Transformed cells were grown on the appropriate media with antibiotic supplementation and colonies were selected based on their appropriate growth on the selective media.

TABLE 44

*E. coli* Genetic Modification Results under Aerobic Conditions

| Strain Name | Media (M9 +) | Parent | Chromosomal Genetic Modifications | Vector based Genetic Modifications | Tolerance Group | MIC Assay Result (g/L 3-HP) | P-value | MIC Assay Number | % Increase Over Control |
| --- | --- | --- | --- | --- | --- | --- | --- | --- | --- |
| BX_00138.0 | Kan (20 µg/mL) | BW25113 | wild type | pSmart-LC-Kan | None | 25 | <0.1 | ≥3 | — |
| BX_00300.0 | Kan 20 µg/mL | BW25113 | wild type | pSmart-LC-Kan-tyrA-aroF | A | 35 | <0.1 | ≥3 | 40 |
| BX_00301.0 | Kan 20 µg/mL | BW25113 | wild type | pSmart-LC-Kan-folA-C1 | A | 35 | <0.1 | ≥3 | 40 |
| BX_00302.0 | Kan 20 µg/mL | BW25113 | wild type | pSmart-LC-Kan-folA-ORF | A | 30 | <0.1 | ≥3 | 20 |
| BX_00304.0 | Kan 20 µg/mL | BW25113 | wild type | pSmart-LC-Kan-menA-ORF | A | 35 | <0.1 | ≥3 | 40 |
| BX_00305.0 | Kan 20 µg/mL | BW25113 | wild type | pSmart-LC-Kan-pheA-C1 | A | 35 | <0.1 | ≥3 | 40 |
| BX_00307.0 | Kan 20 µg/mL | BW25113 | wild type | pSmart-LC-Kan-tyrA-C1 | A | 35 | <0.1 | ≥3 | 40 |
| BX_00309.0 | Kan 20 µg/mL | BW25113 | wild type | pSmart-LC-Kan-cynTS | C | 35 | <0.1 | ≥3 | 40 |
| BX_00310.0 | Kan 20 µg/mL | BW25113 | wild type | pSmart-LC-Kan-glyA | B | 35 | <0.1 | ≥3 | 40 |
| BX_00312.0 | Kan 20 µg/mL | BW25113 | wild type | pSmart-LC-Kan-serA | B | 35 | <0.1 | ≥3 | 40 |
| BX_00313.0 | Kan 20 µg/mL | BW25113 | wild type | pSmart-LC-Kan-folD | A | 30 | <0.1 | ≥3 | 20 |
| BX_00314.0 | Kan 20 µg/mL | BW25113 | wild type | pSmart-LC-Kan-aroE | A | 35 | <0.1 | ≥3 | 40 |
| BX_00315.0 | Kan 20 µg/mL | BW25113 | wild type | pSmart-LC-Kan-aroKB C1 | A | 35 | <0.1 | ≥3 | 40 |
| BX_00317.0 | Kan 20 µg/mL | BW25113 | wild type | pSmart-LC-Kan-ilvA operon | B | 35 | <0.1 | ≥3 | 40 |
| BX_00318.0 | Kan 20 µg/mL | BW25113 | wild type | pSmart-LC-Kan-cysM | B | 35 | <0.1 | ≥3 | 40 |
| BX_00352.0 | Amp 100 µg/mL | BW25113 | wild type | pSmart-LC-Kan-metC C1 | B | 35 | <0.1 | ≥3 | 40 |
| BX_00387.0 | Kan (20 µg/mL) | BW25113 | ΔlysR::frt | pSmart-LC-Kan-menA-ORF | A | 35 | <0.1 | ≥3 | 40 |
| BX_00002.0 | Amp (100 µg/mL) | BW25113 | wild type | pKK223-mcs1 | None | 20 | <0.1 | ≥3 | — |
| BX_00319.0 | Amp 100 µg/mL + 1 mM IPTG | BW25113 | wild type | pK223-aroH | A | 30 | <0.1 | ≥3 | 50 |
| BX_00320.0 | Amp 100 µg/mL + 1 mM IPTG | BW25113 | wild type | pK223-metE C645A | B | 35 | <0.1 | ≥3 | 75 |
| BX_00321.0 | Amp 100 µg/mL + 1 mM IPTG | BW25113 | wild type | pK223-ct-his-thrA | B | 35 | <0.1 | ≥3 | 75 |
| BX_00357.0 | Amp 100 µg/mL + 1 mM IPTG | BW25113 | wild type | pKK223-aroH*445 | A | 30 | <0.1 | ≥3 | 50 |
| BX_00358.0 | Amp 100 µg/mL + 1 mM IPTG | BW25113 | wild type | pKK223-aroH*447 | A | 35 | <0.1 | ≥3 | 75 |
| BX_00359.0 | Amp 100 µg/mL + 1 mM IPTG | BW25113 | wild type | pKK223-aroH*457 | A | 35 | <0.1 | ≥3 | 75 |
| BX_00118.0 | Kan (20 µg/mL) | BW25113 | wild type | pJ251 | None | 25 | <0.1 | ≥3 | — |
| BX_00322.0 | Kan 20 µg/mL | BW25113 | wild type | pJ61-speFED | C | 35 | <0.1 | ≥3 | 40 |
| BX_00323.0 | Kan 20 µg/mL | BW25113 | wild type | pJ61-aroG | A | 35 | <0.1 | ≥3 | 40 |
| BX_00324.0 | Kan 20 µg/mL | BW25113 | wild type | pJ61-thrA | B | 35 | <0.1 | ≥3 | 40 |
| BX_00325.0 | Kan 20 µg/mL | BW25113 | wild type | pJ61-asd | B | 35 | <0.1 | ≥3 | 40 |
| BX_00326.0 | Kan 20 µg/mL | BW25113 | wild type | pJ61-ilvA | B | 35 | <0.1 | ≥3 | 40 |

TABLE 44-continued

*E. coli* Genetic Modification Results under Aerobic Conditions

| Strain Name | Media (M9 +) | Parent | Chromosomal Genetic Modifications | Vector based Genetic Modifications | Tolerance Group | MIC Assay Result (g/L 3-HP) | P-value | MIC Assay Number | % Increase Over Control |
|---|---|---|---|---|---|---|---|---|---|
| BX_00327.0 | Kan 20 μg/mL | BW25113 | wild type | pJ61-cysM | B | 35 | <0.1 | ≥3 | 40 |
| BX_00361.0 | Kan 20 μg/mL | BW25113 | wild type | pACYC177 (Kan only)-cynTS | C | 35 | <0.1 | ≥3 | 40 |
| BX_00362.0 | Kan 20 μg/mL + 1 mM IPTG | BW25113 | wild type | pACYC177 (Kan only)-aroH | A | 30 | <0.1 | ≥3 | 20 |
| BX_00363.0 | Kan 20 μg/mL | BW25113 | wild type | pACYC177 (kan only)-speB | C | 35 | <0.1 | ≥3 | 40 |
| BX_00364.0 | Kan 20 μg/mL + 1 mM IPTG | BW25113 | wild type | pACYC177 (Kan only)-metE (Version1) (SS090608_13) | B | 35 | <0.1 | ≥3 | 40 |
| BX_00365.0 | Kan 20 μg/mL | BW25113 | wild type | pACYC177 (Kan only)-metC (Version1) (SS090608_17) | B | 35 | <0.1 | ≥3 | 40 |
| BX_00144.0 | Amp (100 μg/mL) | BW25113 | wild type | pSmart-HC-Amp | None | 25 | <0.1 | ≥3 | — |
| BX_00334.0 | Amp 100 μg/mL | BW25113 | wild type | pSmart-HC-Amp-cadA | D | 40 | <0.1 | ≥3 | 60 |
| BX_00335.0 | Amp 100 μg/mL | BW25113 | wild type | pSmart-HC-Amp-prs | E | 35 | <0.1 | ≥3 | 40 |
| BX_00336.0 | Amp 100 μg/mL | BW25113 | wild type | pSmart-HC-Amp-nrdAB | E | 35 | <0.1 | ≥3 | 40 |
| BX_00337.0 | Amp 100 μg/mL | BW25113 | wild type | pSmart-HC-Amp-nrdEF | E | 35 | <0.1 | ≥3 | 40 |
| BX_00353.0 | Amp 100 μg/mL | BW25113 | wild type | pSmart-HC-Amp-metC | B | 45 | <0.1 | ≥3 | 80 |
| BX_00354.0 | Amp 100 μg/mL | BW25113 | wild type | pSmart-HC-Amp-cynTS | C | 45 | <0.1 | ≥3 | 80 |
| BX_00356.0 | Amp 100 μg/mL | BW25113 | wild type | pSmart-HC-Amp-LysA | D | 30 | <0.1 | ≥3 | 20 |
| BX_00419.0 | Amp (100 μg/mL) | BW25113 | ΔlysR::frt | pSmart-HC-Amp-prs | D, E | 30 | <0.1 | ≥3 | 20 |
| BX_00420.0 | Amp (100 μg/mL) | BW25113 | ΔlysR::frt | pSmart-HC-Amp-nrdAB | D, E | 45 | <0.1 | ≥3 | 80 |
| BX_00421.0 | Amp (100 μg/mL) | BW25113 | ΔlysR::frt | pSmart-HC-Amp-nrdEF | D, E | 30 | <0.1 | ≥3 | 20 |
| BX_00425.0 | Amp (100 μg/mL) | BW25113 | ΔnrdR::frt | pSmart-HC-Amp-dapA | D, E | 35 | <0.1 | ≥3 | 40 |
| BX_00426.0 | Amp (100 μg/mL) | BW25113 | ΔnrdR::frt | pSmart-HC-Amp-cadA | D, E | 45 | <0.1 | ≥3 | 80 |
| BX_00437.0 | Amp (100 μg/mL) | BW25113 | ΔlysR::frt | pSmart-HC-Amp-metC | B, D | 30 | <0.1 | ≥3 | 20 |
| BX_00438.0 | Amp (100 μg/mL) | BW25113 | ΔnrdR::frt | pSmart-HC-amp-metC | B, D | 35 | <0.1 | ≥3 | 40 |
| BW25113 | M9 | none | none | none | None | 27.5 | <0.1 | ≥3 | — |
| BX_00341.0 | none | BW25113 | ΔtyrR::frt | none | A | 40 | <0.1 | ≥3 | 45 |
| BX_00342.0 | none | BW25113 | ΔtrpR::frt | none | A | 35 | <0.1 | ≥3 | 27 |
| BX_00345.0 | none | BW25113 | Δmetj::frt | none | B | 35 | <0.1 | ≥3 | 27 |
| BX_00347.0 | none | BW25113 | ΔpurR::frt | none | C | 35 | <0.1 | ≥3 | 27 |
| BX_00348.0 | none | BW25113 | ΔlysR::frt | none | D | 35 | <0.1 | ≥3 | 27 |
| BX_00349.0 | none | BW25113 | ΔnrdR::frt | none | E | 35 | <0.1 | ≥3 | 27 |
| BX_00003.0 | Cm (20 μg/mL) | BW25113 | wild type | pBT-3 | None | 25 | <0.1 | ≥3 | — |
| BX_00368.0 | Cm (20 μg/mL) | BW25113 | wild type | pBT-3-cynTS | C | 30 | <0.1 | ≥3 | 20 |
| BX_00370.0 | Cm (20 μg/mL) | BW25113 | wild type | pBT-3-speB | C | 30 | <0.1 | ≥3 | 20 |
| BX_00142.0 | Kan (20 μg/mL), Cm (20 μg/mL) | BW25113 | wild type | pSmart-LC-kan, pBT-3 | None | 20 | <0.1 | ≥3 | — |
| BX_00463.0 | Cm (20 μg/mL)/ Kan (20 μg/mL) + 1 mM IPTG | BW25113 | ΔnrdR::frt | pBT-3-aroH*, pSmart-LC-Kan cynTS | A, C, E | 30 | <0.1 | ≥3 | 50 |
| BX_00468.0 | Cm (20 μg/mL)/ Kan (20 μg/mL) | BW25113 | ΔnrdR::frt | pSmart-LC-Kan-metC, pBT3-cynTS | B, C, E | 30 | <0.1 | ≥3 | 50 |

TABLE 45

*E. coli* Genetic Modification Results under Anaerobic Conditions

| Strain Name | Media (M9 +) | Parent | Chromosomal Genetic Modifications | Vector based Genetic Modifications | Tolerance Group | MIC Assay Result (g/L 3-HP) | P-value | MIC Assay Number | % Increase Over Control |
|---|---|---|---|---|---|---|---|---|---|
| BX_00138.0 | Kan (20 µg/mLl) | BW25113 | wild type | pSmart-LC-Kan | None | 25 | <0.1 | ≥3 | — |
| BX_00311.0 | Kan 20 µg/mL | BW25113 | wild type | pSmart-LC-Kan-glyA-ORF | B | 30 | <0.1 | ≥3 | 20 |
| BX_00002.0 | Amp (100 µg/mL) | BW25113 | wild type | pKK223-mcs1 | None | 15 | <0.1 | ≥3 | — |
| BX_00319.0 | Amp 100 µg/mL + 1 mM IPTG | BW25113 | wild type | pK223-aroH | A | 20 | <0.1 | ≥3 | 33 |
| BX_00320.0 | Amp 100 µg/mL + 1 mM IPTG | BW25113 | wild type | pK223-metE C645A | B | 20 | <0.1 | ≥3 | 33 |
| BX_00321.0 | Amp 100 µg/mL + 1 mM IPTG | BW25113 | wild type | pK223-ct-his-thrA | B | 20 | <0.1 | ≥3 | 33 |
| BX_00357.0 | Amp 100 µg/mL + 1 mM IPTG | BW25113 | wild type | pKK223-aroH*445 | B | 20 | <0.1 | ≥3 | 33 |
| BX_00358.0 | Amp 100 µg/mL + 1 mM IPTG | BW25113 | wild type | pKK223-aroH*447 | A | 20 | <0.1 | ≥3 | 33 |
| BX_00359.0 | Amp 100 µg/mL + 1 mM IPTG | BW25113 | wild type | pKK223-aroH*457 | A | 20 | <0.1 | ≥3 | 33 |
| BX_00118.0 | Kan (20 µg/mL) | BW25113 | wild type | pJ251 | None | 15 | <0.1 | ≥3 | — |
| BX_00322.0 | Kan 20 µg/mL | BW25113 | wild type | pJ61-speFED | C | 25 | <0.1 | ≥3 | 67 |
| BX_00323.0 | Kan 20 µg/mL | BW25113 | wild type | pJ61-aroG | A | 20 | <0.1 | ≥3 | 33 |
| BX_00324.0 | Kan 20 µg/mL | BW25113 | wild type | pJ61-thrA | B | 20 | <0.1 | ≥3 | 33 |
| BX_00325.0 | Kan 20 µg/mL | BW25113 | wild type | pJ61-asd | B | 20 | <0.1 | ≥3 | 33 |
| BX_00326.0 | Kan 20 µg/mL | BW25113 | wild type | pJ61-ilvA | B | 20 | <0.1 | ≥3 | 33 |
| BX_00327.0 | Kan 20 µg/mL | BW25113 | wild type | pJ61-cysM | B | 20 | <0.1 | ≥3 | 33 |
| BX_00360.0 | Kan 20 µg/mL | BW25113 | wild type | pACYC177(Kan only)-cynTS | C | 20 | <0.1 | ≥3 | 33 |
| BX_00362.0 | Kan 20 µg/mL + 1 mM IPTG | BW25113 | wild type | pACYC177(Kan only)-aroH | A | 20 | <0.1 | ≥3 | 33 |
| BX_00363.0 | Kan 20 µg/mL | BW25113 | wild type | pACYC177(Kan only)-speB | C | 20 | <0.1 | ≥3 | 33 |
| BX_00364.0 | Kan 20 µg/mL + 1 mM IPTG | BW25113 | wild type | pACYC177(Kan only)-metE | B | 20 | <0.1 | ≥3 | 33 |
| BX_00365.0 | Kan 20 µg/mL | BW25113 | wild type | pACYC177(Kan only)-metC | B | 20 | <0.1 | ≥3 | 33 |
| BX_00144.0 | Amp (100 µg/mL) | BW25113 | wild type | pSmart-HC-Amp | None | 25 | <0.1 | ≥3 | — |
| BX_00426.0 | Amp (100 µg/mL) | BW25113 | ΔnrdR::frt | pSmart-HC-Amp-cadA | D, E | 26.7 | <0.1 | ≥3 | 7 |
| BX_00003.0 | Cm (20 µg/mL) | BW25113 | wild type | pBT-3 | None | 15 | <0.1 | ≥3 | — |
| BX_00368.0 | Cm (20 µg/mL) | BW25113 | wild type | pBT-3-cynTS | C | 20 | <0.1 | ≥3 | 33 |

Example 49

Evaluation of 3HPTGC-Related Supplements on Wild-Type *E. coli*

The effect of supplementation on 3HP tolerance was determined by MIC evaluations using the methods described in the Common Methods Section. Supplements tested are listed in Table 46. Results of the MIC evaluations are provided in Table 47 for aerobic condition and Table 48 for anaerobic condition. This data, which includes single and multiple-supplement additions, demonstrates improvement in 3-HP tolerance in these culture systems based on 24-hour MIC evaluations.

TABLE 46

Supplements

| Supplement | Source | TGC Group | Concentration, g/L | Note |
|---|---|---|---|---|
| Tyrosine | Sigma, St. Louis, MO | A | 0.036 | dissolve in 0.01 KOH, pH final to 7 |
| Phenylalanine | Sigma, St. Louis, MO | A | 0.0664 | |
| Tryptophan | Sigma, St. Louis, MO | A | 0.0208 | |
| Shikimate | Sigma, St. Louis, MO | A | 0.1 | |
| p-aminobenzoate | MP Biomedicals, Aurora, OH | A | 0.069 | |
| Dihydroxybenzoate | Sigma, St. Louis, MO | A | 0.077 | |
| Tetrahydrofolate | Sigma, St. Louis, MO | A | 0.015 | 10% DMSO |
| Homocysteine | MP Biomedicals, Aurora, OH | B | 0.008 | |
| Isoleucine | Sigma, St. Louis, MO | B | 0.0052 | |
| Serine | Sigma, St. Louis, MO | B | 1.05 | |
| Glycine | Fisher Scientific, Fair Lawn, NJ | B | 0.06 | |

TABLE 46-continued

| Supplements | | | | |
|---|---|---|---|---|
| Supplement | Source | TGC Group | Concentration, g/L | Note |
| Methionine | Sigma, St. Louis, MO | B | 0.03 | |
| Threonine | Sigma, St. Louis, MO | B | 0.0476 | |
| 2-oxobutyrate | Fluka Biochemika, Hungary | B | 0.051 | |
| Homoserine | Acros Organics, NJ | B | 0.008 | |
| Aspartate | Sigma, St. Louis, MO | B | 0.0684 | |
| Putrescine | MP Biomedicals, Salon, OH | C | 0.9 | |
| Cadaverine | MP Biomedicals, Salon, OH | C | 0.6 | |
| Spermidine | MP Biomedicals, Salon, OH | C | 0.5 | |
| Ornithine | Sigma, St. Louis, MO | C | 0.2 | |
| Citrulline | Sigma, St. Louis, MO | C | 0.2 | |
| Bicarbonate | Fisher Scientific, Fair Lawn, NJ | C | 1 | |
| Glutamine | Sigma, St. Louis, MO | C | 0.09 | dissolve in 1M HCl, pH final to 7 |
| Lysine | Sigma, St. Louis, MO | D | 0.0732 | |
| Uracil | Sigma, St. Louis, MO | E | 0.224 | |
| Citrate | Fisher Scientific, Fair Lawn, NJ | F | 2 | |
| Chorismate Group Mix (includes all Group A supplements listed above) | See above | A | See respective concentrations above | |
| Homocysteine Group Mix (includes all Group B supplements listed above) | See above | B | See respective concentrations above | |
| Polyamine Group Mix (includes all Group C supplements listed above) | See above | C | See respective concentrations above | |

TABLE 47

E. coli Supplement Results under Aerobic Conditions

| Strain Name | Media | Supplements (Group) | average MIC Assay Result (g/L 3-HP) | P-value | MIC Assay Number | % Increase Over Control |
|---|---|---|---|---|---|---|
| CONTROLS | BW25113 | M9 | none | 28 | <0.1 | ≥3 | — |
| | BW25113 | EZ Rich | none | 75 | <0.1 | ≥3 | 173 |
| | BW25113 | M9 | Phenylalanine (A) | 32 | <0.1 | ≥3 | 17 |
| | BW25113 | M9 | Shikimate (A) | 28 | <0.1 | ≥3 | 3 |
| | BW25113 | M9 | p-aminobenzoate (A) | 35 | <0.1 | ≥3 | 27 |
| | BW25113 | M9 | Dihydroxybenzoate (A) | 35 | <0.1 | ≥3 | 27 |
| | BW25113 | M9 | Tetrahydrofolate (A) | 30 | <0.1 | ≥3 | 9 |
| | BW25113 | M9 | Chorismate Group Mix (A) | 30 | <0.1 | ≥3 | 9 |
| | BW25113 | M9 | Homocysteine (B) | 30 | <0.1 | ≥3 | 9 |
| | BW25113 | M9 | Isoleucine (B) | 32 | <0.1 | ≥3 | 17 |
| | BW25113 | M9 | Serine (B) | 32 | <0.1 | ≥3 | 17 |
| | BW25113 | M9 | Glycine (B) | 28 | <0.1 | ≥3 | 3 |
| | BW25113 | M9 | Methionine (B) | 38 | <0.1 | ≥3 | 36 |
| | BW25113 | M9 | Threonine (B) | 32 | <0.1 | ≥3 | 17 |
| | BW25113 | M9 | Homoserine (B) | 35 | <0.1 | ≥3 | 27 |
| | BW25113 | M9 | Homocysteine Group Mix (B) | 40 | <0.1 | ≥3 | 45 |
| | BW25113 | M9 | Putrescine (C) | 30 | <0.1 | ≥3 | 9 |
| | BW25113 | M9 | Cadaverine (C) | 35 | <0.1 | ≥3 | 27 |
| | BW25113 | M9 | Spermidine (C) | 40 | <0.1 | ≥3 | 45 |
| | BW25113 | M9 | Ornithine (C) | 30 | <0.1 | ≥3 | 9 |
| | BW25113 | M9 | Citrulline (C) | 30 | <0.1 | ≥3 | 9 |
| | BW25113 | M9 | Bicarbonate (C) | 44 | <0.1 | ≥3 | 59 |
| | BW25113 | M9 | Glutamine (C) | 30 | <0.1 | ≥3 | 9 |
| | BW25113 | M9 | Polyamine Group Mix (C) | 57 | <0.1 | ≥3 | 106 |
| | BW25113 | M9 | Lysine (D) | 37 | <0.1 | ≥3 | 33 |

TABLE 47-continued

E. coli Supplement Results under Aerobic Conditions

|  | Strain Name | Media | Supplements (Group) | average MIC Assay Result (g/L 3-HP) | P-value | MIC Assay Number | % Increase Over Control |
|---|---|---|---|---|---|---|---|
| Double Supplements | BW25113 | M9 | Tyrosine (A), Homocysteine (B) | 35 | <0.1 | ≥3 | 27 |
|  | BW25113 | M9 | Tyrosine (A), Methionine (B) | 30 | <0.1 | ≥3 | 9 |
|  | BW25113 | M9 | Tyrosine (A), Isoleucine (B) | 30 | <0.1 | ≥3 | 9 |
|  | BW25113 | M9 | Tyrosine (A), Putrescine (C) | 40 | <0.1 | ≥3 | 45 |
|  | BW25113 | M9 | Tyrosine (A), Spermidine (C) | 40 | <0.1 | ≥3 | 45 |
|  | BW25113 | M9 | Tyrosine (A), Ornithine (C) | 30 | <0.1 | ≥3 | 9 |
|  | BW25113 | M9 | Tyrosine (A), Bicarbonate (C) | 35 | <0.1 | ≥3 | 27 |
|  | BW25113 | M9 | Tyrosine (A), Lysine (D) | 30 | <0.1 | ≥3 | 9 |
|  | BW25113 | M9 | Tyrosine (A), Citrate (F) | 35 | <0.1 | ≥3 | 27 |
|  | BW25113 | M9 | Shikimate (A), Methionine (B) | 30 | <0.1 | ≥3 | 9 |
|  | BW25113 | M9 | Shikimate (A), Bicarbonate (C) | 30 | <0.1 | ≥3 | 9 |
|  | BW25113 | M9 | Shikimate (A), Uracil (E) | 30 | <0.1 | ≥3 | 9 |
|  | BW25113 | M9 | Tetrahydrofolate (A), Methionine (B) | 30 | <0.1 | ≥3 | 9 |
|  | BW25113 | M9 | Tetrahydrofolate (A), Homocysteine (B) | 30 | <0.1 | ≥3 | 9 |
|  | BW25113 | M9 | Tetrahydrofolate (A), Putrescine (C) | 35 | <0.1 | ≥3 | 27 |
|  | BW25113 | M9 | Tetrahydrofolate (A), Spermidine (C) | 40 | <0.1 | ≥3 | 45 |
|  | BW25113 | M9 | Tetrahydrofolate (A), Ornithine (C) | 35 | <0.1 | ≥3 | 27 |
|  | BW25113 | M9 | Tetrahydrofolate (A), Bicarbonate (C) | 30 | <0.1 | ≥3 | 9 |
|  | BW25113 | M9 | Tetrahydrofolate (A), Uracil (E) | 30 | <0.1 | ≥3 | 9 |
|  | BW25113 | M9 | Tetrahydrofolate (A), Citrate (F) | 30 | <0.1 | ≥3 | 9 |
|  | BW25113 | M9 | Methionine (B), Putrescine (C) | 47 | <0.1 | ≥3 | 70 |
|  | BW25113 | M9 | Methionine (B), Spermidine (C) | 40 | <0.1 | ≥3 | 45 |
|  | BW25113 | M9 | Methionine (B), Ornithine (C) | 45 | <0.1 | ≥3 | 64 |
|  | BW25113 | M9 | Methionine (B), Bicarbonate (C) | 35 | <0.1 | ≥3 | 27 |
|  | BW25113 | M9 | Methionine (B), Lysine (D) | 30 | <0.1 | ≥3 | 9 |
|  | BW25113 | M9 | Methionine (B), Uracil (E) | 35 | <0.1 | ≥3 | 27 |
|  | BW25113 | M9 | Methionine (B), Citrate (F) | 30 | <0.1 | ≥3 | 9 |
|  | BW25113 | M9 | Homocysteine (B), Putrescine (C) | 40 | <0.1 | ≥3 | 45 |
|  | BW25113 | M9 | Homocysteine (B), Spermidine (C) | 45 | <0.1 | ≥3 | 64 |
|  | BW25113 | M9 | Homocysteine (B), Ornithine (C) | 30 | <0.1 | ≥3 | 9 |
|  | BW25113 | M9 | Homocysteine (B), Bicarbonate (C) | 42 | <0.1 | ≥3 | 52 |
|  | BW25113 | M9 | Homocysteine (B), Lysine (D) | 35 | <0.1 | ≥3 | 27 |
|  | BW25113 | M9 | Homocysteine (B), Uracil (E) | 30 | <0.1 | ≥3 | 9 |
|  | BW25113 | M9 | Homocysteine (B), Citrate (F) | 30 | <0.1 | ≥3 | 9 |
|  | BW25113 | M9 | Isoleucine (B), Putrescine (C) | 35 | <0.1 | ≥3 | 27 |
|  | BW25113 | M9 | Isoleucine (B), Spermidine (C) | 35 | <0.1 | ≥3 | 27 |
|  | BW25113 | M9 | Isoleucine (B), Bicarbonate (C) | 35 | <0.1 | ≥3 | 27 |
|  | BW25113 | M9 | Isoleucine (B), Lysine (D) | 30 | <0.1 | ≥3 | 9 |
|  | BW25113 | M9 | Isoleucine (B), Uracil (E) | 35 | <0.1 | ≥3 | 27 |
|  | BW25113 | M9 | Isoleucine (B), Citrate (F) | 35 | <0.1 | ≥3 | 27 |
|  | BW25113 | M9 | Putrescine (C), Lysine (D) | 42 | <0.1 | ≥3 | 52 |
|  | BW25113 | M9 | Putrescine (C), Uracil (E) | 30 | <0.1 | ≥3 | 9 |
|  | BW25113 | M9 | Putrescine (C), Citrate (F) | 30 | <0.1 | ≥3 | 9 |
|  | BW25113 | M9 | Spermidine (C), Lysine (D) | 40 | <0.1 | ≥3 | 45 |
|  | BW25113 | M9 | Spermidine (C), Uracil (E) | 30 | <0.1 | ≥3 | 9 |
|  | BW25113 | M9 | Spermidine (C), Citrate (F) | 38 | <0.1 | ≥3 | 39 |
|  | BW25113 | M9 | Ornithine (C), Lysine (D) | 32 | <0.1 | ≥3 | 15 |
|  | BW25113 | M9 | Ornithine (C), Uracil (E) | 30 | <0.1 | ≥3 | 9 |
|  | BW25113 | M9 | Ornithine (C), Citrate (F) | 30 | <0.1 | ≥3 | 9 |
|  | BW25113 | M9 | Bicarbonate (C), Lysine (D) | 35 | <0.1 | ≥3 | 27 |
|  | BW25113 | M9 | Bicarbonate (C), Uracil (E) | 35 | <0.1 | ≥3 | 27 |
|  | BW25113 | M9 | Bicarbonate (C), Citrate (F) | 40 | <0.1 | ≥3 | 45 |
|  | BW25113 | M9 | Lysine (D), Uracil (E) | 30 | <0.1 | ≥3 | 9 |
|  | BW25113 | M9 | Lysine (D), Citrate (F) | 30 | <0.1 | ≥3 | 9 |
| Triple Supplements | BW25113 | M9 | Tyrosine (A), Methionine (B), Putrescine (C) | 35 | <0.1 | ≥3 | 27 |
|  | BW25113 | M9 | Tyrosine (A), Methionine (B), Spermidine (C) | 35 | <0.1 | ≥3 | 27 |
|  | BW25113 | M9 | Tyrosine (A), Methionine (B), Bicarbonate (C) | 30 | <0.1 | ≥3 | 9 |
|  | BW25113 | M9 | Tyrosine (A), Methionine (B), Lysine (D) | 30 | <0.1 | ≥3 | 9 |
|  | BW25113 | M9 | Tyrosine (A), Methionine (B), Uracil (E) | 40 | <0.1 | ≥3 | 45 |
|  | BW25113 | M9 | Tyrosine (A), Methionine (B), Citrate (F) | 30 | <0.1 | ≥3 | 9 |

TABLE 47-continued

E. coli Supplement Results under Aerobic Conditions

| Strain Name | Media | Supplements (Group) | average MIC Assay Result (g/L 3-HP) | P-value | MIC Assay Number | % Increase Over Control |
|---|---|---|---|---|---|---|
| BW25113 | M9 | Tyrosine (A), Putrescine (C), Homocysteine (B) | 30 | <0.1 | ≥3 | 9 |
| BW25113 | M9 | Tyrosine (A), Putrescine (C), Isoleucine (B) | 28 | <0.1 | ≥3 | 3 |
| BW25113 | M9 | Tyrosine (A), Putrescine (C), Lysine (D) | 35 | <0.1 | ≥3 | 27 |
| BW25113 | M9 | Tyrosine (A), Putrescine (C), Uracil (E) | 30 | <0.1 | ≥3 | 9 |
| BW25113 | M9 | Tyrosine (A), Spermidine (C), Homocysteine (B) | 30 | <0.1 | ≥3 | 9 |
| BW25113 | M9 | Tyrosine (A), Spermidine (C), Isoleucine (B) | 30 | <0.1 | ≥3 | 9 |
| BW25113 | M9 | Tyrosine (A), Spermidine (C), Lysine (D) | 30 | <0.1 | ≥3 | 9 |
| BW25113 | M9 | Tyrosine (A), Spermidine (C), Uracil (E) | 35 | <0.1 | ≥3 | 27 |
| BW25113 | M9 | Tyrosine (A), Spermidine (C), Citrate (F) | 30 | <0.1 | ≥3 | 9 |
| BW25113 | M9 | Tyrosine (A), Bicarbonate (C), Homocysteine (B) | 35 | <0.1 | ≥3 | 27 |
| BW25113 | M9 | Tyrosine (A), Bicarbonate (C), Isoleucine (B) | 35 | <0.1 | ≥3 | 27 |
| BW25113 | M9 | Tyrosine (A), Bicarbonate (C), Lysine (D) | 45 | <0.1 | ≥3 | 64 |
| BW25113 | M9 | Tyrosine (A), Bicarbonate (C), Uracil (E) | 45 | <0.1 | ≥3 | 64 |
| BW25113 | M9 | Tyrosine (A), Bicarbonate (C), Citrate (F) | 40 | <0.1 | ≥3 | 45 |
| BW25113 | M9 | Shikimate (A), Putrescine (C), Homocysteine (B) | 30 | <0.1 | ≥3 | 9 |
| BW25113 | M9 | Shikimate (A), Putrescine (C), Uracil (E) | 30 | <0.1 | ≥3 | 9 |
| BW25113 | M9 | Shikimate (A), Putrescine (C), Methionine (B) | 30 | <0.1 | ≥3 | 9 |
| BW25113 | M9 | Shikimate (A), Spermidine (C), Methionine (B) | 30 | <0.1 | ≥3 | 9 |
| BW25113 | M9 | Shikimate (A), Uracil (C), Homocysteine (B) | 30 | <0.1 | ≥3 | 9 |
| BW25113 | M9 | Shikimate (A), Uracil (C), Isoleucine (B) | 30 | <0.1 | ≥3 | 9 |
| BW25113 | M9 | Shikimate (A), Uracil (C), Methionine (B) | 35 | <0.1 | ≥3 | 27 |
| BW25113 | M9 | Shikimate (A), Uracil (C), Lysine (D) | 30 | <0.1 | ≥3 | 9 |
| BW25113 | M9 | Shikimate (A), Uracil (C), Citrate (F) | 30 | <0.1 | ≥3 | 9 |
| BW25113 | M9 | Methionine (B), Putrescine (C), Lysine (D) | 35 | <0.1 | ≥3 | 27 |
| BW25113 | M9 | Methionine (B), Putrescine (C), Uracil (E) | 35 | <0.1 | ≥3 | 27 |
| BW25113 | M9 | Methionine (B), Putrescine (C), Citrate (F) | 35 | <0.1 | ≥3 | 27 |
| BW25113 | M9 | Methionine (B), Spermidine (C), Lysine (D) | 45 | <0.1 | ≥3 | 64 |
| BW25113 | M9 | Methionine (B), Spermidine (C), Uracil (E) | 35 | <0.1 | ≥3 | 27 |
| BW25113 | M9 | Methionine (B), Spermidine (C), Citrate (F) | 40 | <0.1 | ≥3 | 45 |
| BW25113 | M9 | Methionine (B), Bicarbonate (C), Lysine (D) | 45 | <0.1 | ≥3 | 64 |
| BW25113 | M9 | Methionine (B), Bicarbonate (C), Uracil (E) | 45 | <0.1 | ≥3 | 64 |
| BW25113 | M9 | Methionine (B), Bicarbonate (C), Citrate (F) | 45 | <0.1 | ≥3 | 64 |
| BW25113 | M9 | Methionine (B), Lysine (D), Uracil (E) | 35 | <0.1 | ≥3 | 27 |
| BW25113 | M9 | Homocysteine (B), Bicarbonate (C), Lysine (D) | 50 | <0.1 | ≥3 | 82 |
| BW25113 | M9 | Homocysteine (B), Bicarbonate (C), Uracil (E) | 40 | <0.1 | ≥3 | 45 |
| BW25113 | M9 | Isoleucine (B), Putrescine (C), Lysine (D) | 35 | <0.1 | ≥3 | 27 |
| BW25113 | M9 | Isoleucine (B), Putrescine (C), Uracil (E) | 30 | <0.1 | ≥3 | 9 |

TABLE 47-continued

E. coli Supplement Results under Aerobic Conditions

| | Strain Name | Media | Supplements (Group) | average MIC Assay Result (g/L 3-HP) | P-value | MIC Assay Number | % Increase Over Control |
|---|---|---|---|---|---|---|---|
| | BW25113 | M9 | Isoleucine (B), Putrescine (C), Citrate (F) | 35 | <0.1 | ≥3 | 27 |
| | BW25113 | M9 | Isoleucine (B), Bicarbonate (C), Lysine (D) | 55 | <0.1 | ≥3 | 100 |
| | BW25113 | M9 | Isoleucine (B), Bicarbonate (C), Uracil (E) | 40 | <0.1 | ≥3 | 45 |
| | BW25113 | M9 | Isoleucine (B), Bicarbonate (C), Citrate (F) | 35 | <0.1 | ≥3 | 27 |
| | BW25113 | M9 | Lysine (B), Bicarbonate (C), Uracil (E) | 35 | <0.1 | ≥3 | 27 |
| | BW25113 | M9 | Lysine (B), Bicarbonate (C), Citrate (F) | 35 | <0.1 | ≥3 | 27 |
| | BW25113 | M9 | Methionine (B), Putrescine (C), Lysine (D) | 30 | <0.1 | ≥3 | 9 |
| | BW25113 | M9 | Methionine (B), Bicarbonate (C), Lysine (D) | 30 | <0.1 | ≥3 | 9 |
| 4 Supplements | BW25113 | M9 | Tyrosine (A), Methionine (B), Putrescine (C), Lysine (D) | 50 | <0.1 | ≥3 | 82 |
| | BW25113 | M9 | Tyrosine (A), Methionine (B), Putrescine (C), Uracil (E) | 40 | <0.1 | ≥3 | 45 |
| | BW25113 | M9 | Tyrosine (A), Methionine (B), Putrescine (C), Citrate (F) | 35 | <0.1 | ≥3 | 27 |
| | BW25113 | M9 | Tyrosine (A), Methionine (B), Bicarbonate (C), Lysine (D) | 40 | <0.1 | ≥3 | 45 |
| | BW25113 | M9 | Tyrosine (A), Methionine (B), Bicarbonate (C), Uracil (E) | 40 | <0.1 | ≥3 | 45 |
| | BW25113 | M9 | Tyrosine (A), Methionine (B), Bicarbonate (C), Citrate (F) | 45 | <0.1 | ≥3 | 64 |
| | BW25113 | M9 | Tyrosine (A), Putrescine (C), Homocysteine (B), Lysine (D) | 40 | <0.1 | ≥3 | 45 |
| | BW25113 | M9 | Tyrosine (A), Putrescine (C), Homocysteine (B), Uracil (E) | 30 | <0.1 | ≥3 | 9 |
| | BW25113 | M9 | Tyrosine (A), Putrescine (C), Homocysteine (B), Citrate (F) | 35 | <0.1 | ≥3 | 27 |
| | BW25113 | M9 | Tyrosine (A), Bicarbonate (C), Homocysteine (B), Uracil (E) | 30 | <0.1 | ≥3 | 9 |
| | BW25113 | M9 | Tyrosine (A), Bicarbonate (C), Homocysteine (B), Citrate (F) | 35 | <0.1 | ≥3 | 27 |
| | BW25113 | M9 | Shikimate (A), Putrescine (C), Methionine (B), Lysine (D) | 30 | <0.1 | ≥3 | 9 |
| | BW25113 | M9 | Shikimate (A), Putrescine (C), Methionine (B), Uracil (E) | 35 | <0.1 | ≥3 | 27 |
| | BW25113 | M9 | Shikimate (A), Putrescine (C), Methionine (B), Citrate (F) | 30 | <0.1 | ≥3 | 9 |
| | BW25113 | M9 | Shikimate (A), Uracil (E), Methionine (B), Lysine (D) | 35 | <0.1 | ≥3 | 27 |
| | BW25113 | M9 | Shikimate (A), Uracil (E), Methionine (B), Bicarbonate (C) | 35 | <0.1 | ≥3 | 27 |
| | BW25113 | M9 | Shikimate (A), Uracil (E), Methionine (B), Citrate (F) | 30 | <0.1 | ≥3 | 9 |
| | BW25113 | M9 | Methionine (B), Putrescine (C), Lysine (D), Uracil (E) | 30 | <0.1 | ≥3 | 9 |
| | BW25113 | M9 | Methionine (B), Bicarbonate (C), Lysine (D), Uracil (E) | 30 | <0.1 | ≥3 | 9 |
| | BW25113 | M9 | Methionine (B), Bicarbonate (C), Lysine (D), Citrate (F) | 35 | <0.1 | ≥3 | 27 |
| | BW25113 | M9 | Bicarbonate (C), Lysine (D), Uracil (E), Citrate (F) | 30 | <0.1 | ≥3 | 9 |
| | BW25113 | M9 | Methionine (B), Lysine (D), Uracil (E), Citrate (F) | 35 | <0.1 | ≥3 | 27 |
| 5 supplements | BW25113 | M9 | Shikimate (A), Methionine (B), Bicarbonate (C), Lysine (D), Uracil (E) | 40 | <0.1 | ≥3 | 45 |
| | BW25113 | M9 | Shikimate (A), Homocsyteine (B), Bicarbonate (C), Lysine (D), Uracil (E) | 40 | <0.1 | ≥3 | 45 |
| | BW25113 | M9 | Tyrosine (A), Methionine (B), Bicarbonate (C), Lysine (D), Citrate (F) | 40 | <0.1 | ≥3 | 45 |
| | BW25113 | M9 | Shikimate (A), Methionine (B), Bicarbonate (C), Lysine (D), Citrate (F) | 40 | <0.1 | ≥3 | 45 |

TABLE 47-continued

E. coli Supplement Results under Aerobic Conditions

|   | Strain Name | Media | Supplements (Group) | average MIC Assay Result (g/L 3-HP) | P-value | MIC Assay Number | % Increase Over Control |
|---|---|---|---|---|---|---|---|
| | BW25113 | M9 | Shikimate (A), Homocsyteine (B), Bicarbonate (C), Lysine (D), Citrate (F) | 40 | <0.1 | ≥3 | 45 |
| | BW25113 | M9 | Methionine (B), Bicarbonate (C), Lysine (D), Uracil (E), Citric (F) | 40 | <0.1 | ≥3 | 45 |
| | BW25113 | M9 | Tyrosine (A), Methionine (B), Bicarbonate (C), Lysine (D), Uracil (E) | 37 | <0.1 | ≥3 | 33 |
| | BW25113 | M9 | Tyrosine (A), Methionine (B), Putrescine (C), Lysine (D), Uracil (E) | 35 | <0.1 | ≥3 | 27 |
| | BW25113 | M9 | Shikimate (A), Methionine (B), Putrescine (C), Lysine (D), Uracil (E) | 35 | <0.1 | ≥3 | 27 |
| | BW25113 | M9 | Tyrosine (A), Homocysteine (B), Putrescine (C), Lysine (D), Uracil (E) | 35 | <0.1 | ≥3 | 27 |
| | BW25113 | M9 | Shikimate (A), Homocsyteine (B), Putrescine (C), Lysine (D), Uracil (E) | 35 | <0.1 | ≥3 | 27 |
| | BW25113 | M9 | Tyrosine (A), Methionine (B), Putrescine (C), Lysine (D), Citrate (F) | 35 | <0.1 | ≥3 | 27 |
| | BW25113 | M9 | Tyrosine (A), Homocysteine (B), Putrescine (C), Lysine (D), Citrate (F) | 35 | <0.1 | ≥3 | 27 |
| | BW25113 | M9 | Shikimate (A), Homocsyteine (B), Putrescine (C), Lysine (D), Citrate (F) | 35 | <0.1 | ≥3 | 27 |
| | BW25113 | M9 | Tyrosine (A), Homocysteine (B), Bicarbonate (C), Lysine (D), Citrate (F) | 35 | <0.1 | ≥3 | 27 |
| | BW25113 | M9 | Methionine (B), Spermidine (C), Lysine (D), Uracil (E), Citric (F) | 35 | <0.1 | ≥3 | 27 |
| | BW25113 | M9 | Methionine (B), Putrescine (C), Lysine (D), Uracil (E), Citric (F) | 35 | <0.1 | ≥3 | 27 |
| | BW25113 | M9 | Tyrosine (A), Bicarbonate (C), Lysine (D), Uracil (E), Citrate (F) | 35 | <0.1 | ≥3 | 27 |
| | BW25113 | M9 | Tyrosine (A), Methionine (B), Lysine (D), Uracil (E), Citrate (F) | 35 | <0.1 | ≥3 | 27 |
| | BW25113 | M9 | Shikimate (A), Methionine (B), Lysine (D), Uracil (E), Citrate (F) | 35 | <0.1 | ≥3 | 27 |
| | BW25113 | M9 | Shikimate (A), Putrescine (C), Lysine (D), Uracil (E), Citrate (F) | 30 | <0.1 | ≥3 | 9 |
| | BW25113 | M9 | Tyrosine (A), Homocysteine (B), Bicarbonate (C), Lysine (D), Uracil (E) | 38 | <0.1 | ≥3 | 39 |
| | BW25113 | M9 | Shikimate (A), Methionine (B), Putrescine (C), Lysine (D), Citrate (F) | 30 | <0.1 | ≥3 | 9 |
| 6 supplements | BW25113 | M9 | Tyrosine (A), Methionine (B), Putrescine (C), Lysine (D), Uracil (E), Citrate (F) | 42 | <0.1 | ≥3 | 52 |
| | BW25113 | M9 | Shikimate (A), Methionine (B), Bicarbonate (C), Lysine (D), Uracil (E), Citrate (F) | 40 | <0.1 | ≥3 | 45 |
| | BW25113 | M9 | Shikimate (A), Methionine (B), Putrescine (C), Lysine (D), Uracil (E), Citrate (F) | 35 | <0.1 | ≥3 | 27 |
| | BW25113 | M9 | Tyrosine (A), Methionine (B), Bicarbonate (C), Lysine (D), Uracil (E), Citrate (F) | 37 | <0.1 | ≥3 | 33 |

TABLE 48

| | Strain Name | Media | Supplements (Group) | MIC Assay Result (g/L 3-HP) | P-value | MIC Assay Number | % Increase Over Control |
|---|---|---|---|---|---|---|---|
| CONTROLS | BW25113 | M9 | none | 30.0 | <0.1 | ≥3 | — |
| | BW25113 | EZ Rich | none | 75.0 | <0.1 | ≥3 | 150 |
| Single Supplements | | | | | | | |
| | BW25113 | M9 | Phenylalanine (A) | 32.1 | <0.1 | ≥3 | 7 |
| | BW25113 | M9 | p-aminobenzoate (A) | 40.0 | <0.1 | ≥3 | 33 |
| | BW25113 | M9 | Dihydroxybenzoate (A) | 40.0 | <0.1 | ≥3 | 33 |
| | BW25113 | M9 | Tetrahydrofolate (A) | 40.0 | <0.1 | ≥3 | 33 |
| | BW25113 | M9 | Serine (B) | 32.1 | <0.1 | ≥3 | 7 |
| | BW25113 | M9 | Methionine (B) | 42.8 | <0.1 | ≥3 | 43 |
| | BW25113 | M9 | Homoserine (B) | 30.0 | <0.1 | ≥3 | 0 |
| | BW25113 | M9 | Homocysteine Group Mix (B) | 45.0 | <0.1 | ≥3 | 50 |
| | BW25113 | M9 | Putrescine(C) | 35.0 | <0.1 | ≥3 | 17 |
| | BW25113 | M9 | Spermidine (C) | 35.0 | <0.1 | ≥3 | 17 |
| | BW25113 | M9 | Polyamine Group Mix (C) | 60.0 | <0.1 | ≥3 | 100 |
| | BW25113 | M9 | Lysine (D) | 41.7 | <0.1 | ≥3 | 39 |
| Double Supplements | | | | | | | |
| | BW25113 | M9 | Tetrahydrofolate (A), Putrescine (C) | 35.0 | <0.1 | ≥3 | 17 |
| | BW25113 | M9 | Tetrahydrofolate (A), Spermidine (C) | 30.0 | <0.1 | ≥3 | 0 |
| | BW25113 | M9 | Tetrahydrofolate (A), Bicarbonate (C) | 35.0 | <0.1 | ≥3 | 17 |
| | BW25113 | M9 | Tetrahydrofolate (A), Lysine (D) | 35.0 | <0.1 | ≥3 | 17 |
| | BW25113 | M9 | Homocysteine (B), Bicarbonate (C) | 35.0 | <0.1 | ≥3 | 17 |
| | BW25113 | M9 | Putrescine (C), Lysine (D) | 30.0 | <0.1 | ≥3 | 0 |
| | BW25113 | M9 | Putrescine (C), Citrate (F) | 36.7 | <0.1 | ≥3 | 22 |
| Triple Supplements | | | | | | | |
| | BW25113 | M9 | Methionine (B), Spermidine (C), Lysine (D) | 35.0 | <0.1 | ≥3 | 17 |
| | BW25113 | M9 | Isolucine (B), Putrescine (C), Lysine (D) | 35.0 | <0.1 | ≥3 | 17 |
| 4 Supplements | | | | | | | |
| | BW25113 | M9 | Tyrosine (A), Methionine (B), Putrescine (C), Lysine (D) | 40.0 | <0.1 | ≥3 | 33 |
| | BW25113 | M9 | Tyrosine (A), Methionine (B), Bicarbonate (C), Lysine (D) | 35.0 | <0.1 | ≥3 | 17 |
| | BW25113 | M9 | Tyrosine (A), Methionine (B), Bicarbonate (C), Citrate (F) | 35.0 | <0.1 | ≥3 | 17 |

Example 50

Evaluation of 3HPTGC-Related Genetically Modified *E. coli*

Example 50 provides a direct comparison of one genetic modification of the 3HPTC with a control using a growth rate-based toleragram over a 24-hour period.

The effects of genetic modifications on 3HP tolerance were determined by MIC evaluations using the methods described in the Common Methods Section. Genetic modifications tested in *E. coli* and the MIC results thereof are listed in Table 44 for aerobic condition and Table 45 for anaerobic condition. This data, which includes single and multiple genetic modifications, demonstrates improvement in 3-HP tolerance in these culture systems based on 24-hour MIC evaluations.

Example 51

Toleragram Comparison with CynTS Genetic Modification

Twenty-four hour duration toleragram evaluations were conducted to compare a control (wild-type) *E. coli* (strain BW25113) with a genetically modified *E. coli* (strain BW25113) comprising a genetic modification to introduce cynTS.

Results are provided in the figures, which show the control strain also tested under indicated additional conditions.

Based on the area under the curve, the cynTS treatment is demonstrated to exhibit greater tolerance to 3-HP, at various elevated 3-HP concentrations, versus the control.

Example 52

Genetic Modification/Introduction of Tolerance Pieces into *Bacillus subtilis*

For creation of a 3-HP production tolerance pieces into *Bacillus subtilis* several genes from the *E. coli* toleragenic complex were cloned into a *Bacillus* shuttle vector, pWH1520 (SEQ ID NO:010) obtained from Boca Scientific (Boca Raton, Fla. USA). This shuttle vector carries an inducible Pxyl xylose-inducible promoter, as well as an ampicillin resistance cassette for propagation in *E. coli* and a tetracycline resistance cassette for propagation in *Bacillus subtilis*. Cloning strategies for these genes are shown in Table 49.

TABLE 49

B. subtilis Tolerance Plasmid Construction

| Gene(s) or Region Name | Vector | Cloning Method | Primer A | Primer B | PCR Sequence or Codon Optimized Sequence (Region) | Plasmid Name |
|---|---|---|---|---|---|---|
| speB | pWH1520 | A | SEQ ID. 0142 | SEQ ID. 0143 | SEQ ID. 0144 | pWH1520-Pxyl:speB |
| metE | pWH1520 | A | SEQ ID 0145 | SEQ ID 0146 | SEQ ID 0147 | pWH1520-Pxyl:metE |

Method A

Tolerance genes cloned for testing in *B. subtilis* designated a cloning method A in Table 49 were created in a similar manner. The cloning method described here places the gene under the xylose-inducible promoter. Each gene was amplified by polymerase chain reaction using their corresponding Primers A and Primer B listed in each row of the table. Primer A of each set contains homology to the start of the gene and a SpeI restriction site. Primer B contains homology for the region downstream of the stop codon of the gene and a BamHI restriction site. The polymerase chain reaction product was purified using a PCR purification kit obtained from Qiagen Corporation (Valencia, Calif. USA) according to manufacturer's instructions. Next, the purified product was digested with SpeI and BamHI obtained from New England BioLabs (Ipswich, Mass. USA) according to manufacturer's instructions. The digestion mixture was separated by agarose gel electrophoresis, and visualized under UV transillumination as described in Subsection II of the Common Methods Section. An agarose gel slice containing a DNA piece corresponding to the digested and purified tolerance gene was cut from the gel and the DNA recovered with a standard gel extraction protocol and components from Qiagen (Valencia, Calif. USA) according to manufacturer's instructions.

This pWH1520 shuttle vector DNA was isolated using a standard miniprep DNA purification kit from Qiagen (Valencia, Calif. USA) according to manufacturer's instructions. The resulting DNA was restriction digested with SpeI and SphI obtained from New England BioLabs (Ipswich, Mass. USA) according to manufacturer's instructions. The digestion mixture was separated by agarose gel electrophoresis, and visualized under UV transillumination as described in Subsection II of the Common Methods Section. An agarose gel slice containing a DNA piece corresponding to digested pWH1520 backbone product was cut from the gel and the DNA recovered with a standard gel extraction protocol and components from Qiagen (Valencia, Calif. USA) according to manufacturer's instructions.

Both the digested and purified tolerance gene and pWH1520 DNA products were ligated together using T4 ligase obtained from New England BioLabs (Ipswich, Mass. USA) according to manufacturer's instructions. The ligation mixture was then transformed into chemically competent 10G *E. coli* cells obtained from Lucigen Corporation (Middleton Wis., USA) according to the manufacturer's instructions and plated LB plates augmented with ampicillin for selection. Several of the resulting colonies were cultured and their DNA was isolated using a standard miniprep DNA purification kit from Qiagen (Valencia, Calif. USA) according to manufacturer's instructions. The recovered DNA was checked by restriction digest followed by agarose gel electrophoresis. DNA samples showing the correct banding pattern were further verified by DNA sequencing.

Example 53

Genetic Modification/Introduction of Malonyl-CoA Reductase for 3-HP Production in *Bacillus subtilis*

For creation of a 3-HP production pathway in *Bacillus Subtilis* the codon optimized nucleotide sequence for the malonyl-coA reductase gene from *Chloroflexus aurantiacus* that was constructed by the gene synthesis service from DNA 2.0 (Menlo Park, Calif. USA), a commercial DNA gene synthesis provider, was added to a *Bacillus Subtilis* shuttle vector. This shuttle vector, pHT08 (SEQ ID NO:011), was obtained from Boca Scientific (Boca Raton, Fla. USA) and carries an inducible Pgrac IPTG-inducible promoter.

This mcr gene sequence was prepared for insertion into the pHT08 shuttle vector by polymerase chain reaction amplification with primer 1 (5'GGAAGGATCCATGTCCGG-TACGGGTCG-3') (SEQ ID NO:148), which contains homology to the start site of the mcr gene and a BamHI restriction site, and primer 2 (5'-Phos-GGGATTAGACGG-TAATCGCACGACCG-3') (SEQ ID NO:149), which contains the stop codon of the mcr gene and a phosphorylated 5' terminus for blunt ligation cloning. The polymerase chain reaction product was purified using a PCR purification kit obtained from Qiagen Corporation (Valencia, Calif. USA) according to manufacturer's instructions. Next, the purified product was digested with BamHI obtained from New England BioLabs (Ipswich, Mass. USA) according to manufacturer's instructions. The digestion mixture was separated by agarose gel electrophoresis, and visualized under UV transillumination as described in Subsection II of the Common Methods Section. An agarose gel slice containing a DNA piece corresponding to the mcr gene was cut from the gel and the DNA recovered with a standard gel extraction protocol and components from Qiagen (Valencia, Calif. USA) according to manufacturer's instructions.

This pHT08 shuttle vector DNA was isolated using a standard miniprep DNA purification kit from Qiagen (Valencia, Calif. USA) according to manufacturer's instructions. The resulting DNA was restriction digested with BamHI and SmaI obtained from New England BioLabs (Ipswich, Mass. USA) according to manufacturer's instructions. The digestion mixture was separated by agarose gel electrophoresis, and visualized under UV transillumination as described in Subsection II of the Common Methods Section. An agarose gel slice containing a DNA piece corresponding to digested pHT08 backbone product was cut from the gel and the DNA recovered with a standard gel extraction protocol and components from Qiagen (Valencia, Calif. USA) according to manufacturer's instructions.

Both the digested and purified mcr and pHT08 products were ligated together using T4 ligase obtained from New England BioLabs (Ipswich, Mass. USA) according to manufacturer's instructions. The ligation mixture was then transformed into chemically competent 10G *E. coli* cells obtained from Lucigen Corporation (Middleton Wis., USA) according to the manufacturer's instructions and plated LB plates augmented with ampicillin for selection. Several of the resulting colonies were cultured and their DNA was isolated using a standard miniprep DNA purification kit from Qiagen (Valencia, Calif. USA) according to manufacturer's instructions. The recovered DNA was checked by restriction digest followed by agarose gel electrophoresis. DNA samples showing the correct banding pattern were further verified by DNA sequencing. The sequence verified DNA was designated as pHT08-mcr, and was then transformed into chemically competent *Bacillus subtilis* cells using directions obtained from Boca Scientific (Boca Raton, Fla. USA). *Bacillus subtilis* cells carrying the pHT08-mcr plasmid were selected for on LB plates augmented with chloramphenicol.

*Bacillus subtilis* cells carrying the pHT08-mcr, were grown overnight in 5 ml of LB media supplemented with 20 ug/mL chloramphenicol, shaking at 225 rpm and incubated at 37 degrees Celsius. These cultures were used to inoculate 1% v/v, 75 mL of M9 minimal media supplemented with 1.47 g/L glutamate, 0.021 g/L tryptophan, 20 ug/mL chloramphenicol and 1 mM IPTG. These cultures were then grown for 18 hours in a 250 mL baffled Erlenmeyer flask at 25 rpm, incubated at 37 degrees Celsius. After 18 hours, cells were pelleted and supernatants subjected to GCMS detection of 3-HP (described in Common Methods Section Mb)). Trace amounts of 3-HP were detected with qualifier ions.

Example 54

*Bacillus subtilis* Strain Construction

Plasmids for tolerance genetic elements in pWH1520 and the production plasmid, pHT08-mcr, were transformed in to two *Bacillus subtilis* strains. The *Bacillus subtilis* subspecies *subtilis* 168 strain was obtained as a kind a gift from the laboratory of Prof. Ryan T. Gill from the University of Colorado at Boulder. Transformations were performed using a modified protocol developed from Anagnostopoulos and Spizizen (Requirements for transformation in *Bacillus subtilis*. J. Bacteriol. 81:741-746 (1961)) as provided with the instructions for the pHT08 shuttle vector by Boca Scientific (Boca Raton, Fla. USA).

Example 55

Evaluation of 3HPTGC-Related Supplements on Wild-Type *B. subtilis*

The effect of supplementation on 3HP tolerance was determined by MIC evaluations using the methods described in the Common Methods Section. Supplements tested are listed in the Supplements Table. Results of the MIC evaluations under anaerobic condition are provided in Table 50.

TABLE 50

*B. subtilis* Supplement and Genetic Modification Results under Aerobic Conditions

| Strain Name | Media | Supplements | Group Represented | Parent | Chromosomal Genetic Modifications | Vector Based Genetic Modifications | Avg 24 hr ΔOD600 | Standard Error | % Increase Over Control |
|---|---|---|---|---|---|---|---|---|---|
| *B. subtilis* 168 | M9 + glu + trp* | none | none | NA | none | none | 0.04 | 0.004 | 0 |
| *B. subtilis* 168 | M9 + glu + trp | Chorismate Group | A | NA | none | none | 0.26 | 0.043 | 577 |
| *B. subtilis* 168 | M9 + glu + trp | Homocysteine Group Mix | B | NA | none | none | 0.08 | 0.005 | 104 |
| *B. subtilis* 168 | M9 + glu + trp | Methionine | B | NA | none | none | 0.15 | 0.007 | 282 |
| *B. subtilis* 168 | M9 + glu + trp | Bicarbonate | C | NA | none | none | 0.06 | 0.002 | 56 |
| *B. subtilis* 168 | M9 + glu + trp | p-amino-benzoate | A | NA | none | none | 0.07 | 0.015 | 89 |
| *B. subtilis* 168 | M9 + glu + trp | spermidine | C | NA | none | none | 0.09 | 0.024 | 140 |
| *B. subtilis* 168 | M9 + glu + trp | Isoleucine, Bicarbonate, Lysine | B, C, D | NA | none | none | 0.05 | 0.006 | 29 |
| *B. subtilis* 168 | M9 + glu + trp | Citrate | F | NA | none | none | 0.30 | 0.046 | 674 |
| BSX_0003.0 | M9 + glu + trp + 1 mM Xylose | none | none | *B. subtilis* 168 | none | pWH1520 | 0.00 | 0.000 | 0 |
| BSX_0011.0 | M9 + glu + trp + 1 mM Xylose | none | C | *B. subtilis* 168 | none | pWH1520-Pxyl: speB region | 0.07 | 0.060 | ** |
| BSX_0015.0 | M9 + glu + trp + 1 mM Xylose | none | B | *B. subtilis* 168 | none | pWH1520-Pxyl: metE region | 0.06 | 0.063 | ** |

*M9 + glu + trp means M9 minimal + glutamate (1.47 g/L) and tryptophan (0.021 g/L)

**Genetically modified strains had a positive change in growth after 24 hours, compared to control BSX_0003.0 which had a decrease in OD600 after 34 hours resulting in a reading of 0.

Example 56

Evaluation of 3HPTGC-Related Genetically Modified *B. subtilis* without and with 3HPTGC-Related Supplements The effect of supplementation and/or genetic modifications on 3HP tolerance in *B. subtilis* was determined by MIC evaluations using the methods described in the Common Methods Section. Supplements tested are listed in the Supplements Table. Genetic modifications tested and the MIC results under aerobic condition for *B. subtilis* are provided in Table 50. This data, which includes single genetic modifications and single and multiple supplement additions, demonstrates improvement in 3-HP tolerance in this culture system based changes in OD.

Example 57

Yeast Aerobic Pathway for 3HP Production (Prophetic)

The following construct (SEQ ID NO:150) containing: 200 bp 5' homology to ACC1, His3 gene for selection, Adh1 yeast promoter, BamHI and SpeI sites for cloning of MCR, cyc1 terminator, Tef1 promoter from yeast and the first 200 bp of homology to the yeast ACC1 open reading frame will be constructed using gene synthesis (DNA 2.0). The MCR open reading frame (SEQ ID NO:151) will be cloned into the BamHI and SpeI sites, this will allow for constitutive transcription by the adh1 promoter. Following the cloning of MCR into the construct the genetic element (SEQ ID NO:152) will be isolated from the plasmid by restriction digestion and transformed into relevant yeast strains. The genetic element will knock out the native promoter of yeast ACC1 and replace it with MCR expressed from the adh1 promoter and the Tef1 promoter will now drive yeast ACC1 expression. The integration will be selected for by growth in the absence of histidine. Positive colonies will be confirmed by PCR. Expression of MCR and increased expression of ACC1 will be confirmed by RT-PCR.

An alternative approach that could be utilized to express MCR in yeast is expression of MCR from a plasmid. The genetic element containing MCR under the control of the ADH1 promoter (SEQ ID 4) could be cloned into a yeast vector such as pRS421 (SEQ ID NO:153) using standard molecular biology techniques creating a plasmid containing MCR (SEQ ID NO:154). A plasmid based MCR could then be transformed into different yeast strains.

Based on the present disclosure, it is noted that, in addition to introducing a nucleic acid construct that comprises a sequence encoding for malonyl-CoA reductase activity in a yeast cell, in some embodiments additional genetic modifications are made to decrease enoyl-CoA reductase activity and/or other fatty acid synthase activity.

Example 58

Cloning of *Saccharomyces cerevisiae* Genetic Elements for Increased Tolerance to 3HP Yeast genes were identified by homology and pathway comparison using <<biocyc.org>>, outlined in FIG. 9D, sheets 1-7. Genetic elements were amplified by PCR using the primers in Table 51. Yeast genetic elements were amplified to contain native promoters and 3' untranslated region, PCR product sequences Table 51. PCR products were isolated by gel electrophoresis and gel purification using Qiagen gel extraction (Valencia, Calif. USA, Cat. No. 28706) following the manufactures instructions. Gel purified yeast genetic elements were then cloned into pYes2.1-topo vector (SEQ ID NO:183, Invitrogen Corp, Carlsbad, Calif., USA) following manufacture instructions. Colonies were screened by PCR and then sequenced by Genewiz.

TABLE 51

| Yeast Tolerance Primers | | |
|---|---|---|
| Gene | Primer A | Primer B |
| spe3 | SEQ ID 0155 | SEQ ID 0156 |
| hom2 | SEQ ID 0157 | SEQ ID 0158 |
| MET6 | SEQ ID 0159 | SEQ ID 0160 |
| ILV2 | SEQ ID 0161 | SEQ ID 0162 |
| ILV6 | SEQ ID 0163 | SEQ ID 0164 |
| THR1 | SEQ ID 0165 | SEQ ID 0166 |
| SER2 | SEQ ID 0167 | SEQ ID 0168 |
| SER3 | SEQ ID 0169 | SEQ ID 0170 |
| ARG2 | SEQ ID 0171 | SEQ ID 0172 |
| RNR1 | SEQ ID 0173 | SEQ ID 0174 |
| aro3 | SEQ ID 0175 | SEQ ID 0176 |
| ARO7 | SEQ ID 0177 | SEQ ID 0178 |
| TYR1 | SEQ ID 0179 | SEQ ID 0180 |
| TRP1 | SEQ ID 0181 | SEQ ID 0182 |

Example 59

Sub-Cloning Yeast Genetic Elements into *E. coli*/Yeast Shuttle Vectors pRS423 and pRS425

Genetic elements were excised from pYes2.1 by restriction digestion with restriction enzymes PvuII and XbaI. Restriction fragments containing yeast genetic elements were isolated by gel electrophoresis and gel purification using Qiagen gel extraction (Valencia, Calif. USA, Cat. No. 28706) following manufactures instructions. Backbone vectors pRS423 and pRS425 were digested with SmaI and SpeI restriction enzymes and gel purified. Yeast genetic elements were ligated into pRS423 and pRS425 (SEQ ID NO:184 and 185). All plasmids were checked using PCR analysis and sequencing.

Example 60

Yeast Strain Construction

Yeast strains were constructed using standard yeast transformation and selected for by complementation of auxotrophic markers. All strains are S288C background. For general yeast transformation methods, see Gietz, R. D. and R. A. Woods. (2002) "Transformation of Yeast by the Liac/SS Carrier DNA/PEG Method." Methods in Enzymology 350: 87-96.

Example 61

Evaluation of Supplements and/or Genetic Modifications on 3Hp Tolerance in Yeast The effect of supplementation and/or genetic modifications on 3HP tolerance was determined by MIC evaluations using the methods described in this Example. Supplements tested are listed in Tables 52 and 53 for aerobic and anaerobic conditions, respectively. Genetic modifications tested in yeast are listed in Tables 54 and 55 for aerobic and anaerobic conditions, respectively. Results of the MIC evaluations are provided in Tables 52-55. This data, which includes single and multiple supplement additions and genetic modifications, demonstrates improvement in 3-HP tolerance in these culture systems based on the MIC evaluations described herein.

Method for Yeast aerobic Minimum Inhibitory Concentration Evaluation

The minimum inhibitory concentration (MIC) was determined aerobically in a 96 well-plate format. Plates were setup such that each individual well, when brought to a final volume of 100 uL following inoculation, had the following component levels (corresponding to synthetic minimal glucose medium (SD) standard media without vitamins): 20 g/L dextrose, 5 g/L ammonium sulfate, 850 mg/L potassium phosphate monobasic, 150 mg/L potassium phosphate dibasic, 500 mg/L magnesium sulfate, 100 mg/L sodium chloride, 100 mg/L calcium chloride, 500 μg/L boric acid, 40 μg/L copper sulfate, 100 μg/L potassium iodide, 200 μg/L ferric chloride, 400 μg/L manganese sulfate, 200 μg/L sodium molybdate, and 400 μg/L zinc sulfate. Media supplements were added according to levels reported in the Supplements Table, where specified. Overnight cultures of strains were grown in triplicate in 5 mL SD media with vitamins (Methods in Enzymology vol. 350, page 17 (2002)). A 1% (v/v) inoculum was introduced into a 5 ml culture of SD minimal media without vitamins. After the cells reached mid-exponential phase, the culture was diluted to an $OD_{600}$ of 0.200. The cells were further diluted 1:5 and a 10 μL, aliquot was used to inoculate each well of a 96 well plate ($\sim 10^4$ cells per well) to total volume of 100 uL. The plate was arranged to measure the growth of variable strains or growth conditions in increasing 3-HP concentrations, 0 to 60 g/L, in 5 g/L increments. Plates were incubated for 72 hours at 30 C. The minimum inhibitory 3-HP concentration and maximum 3-HP concentration corresponding to visible cell growth (OD~0.1) was recorded after 72 hours. For cases when MIC >60 g/L, assessments were performed in plates with extended 3-HP concentrations (0-100 g/L, in 5 g/L increments).

Method for Yeast Anaerobic Minimum Inhibitory Concentration Evaluation

The minimum inhibitory concentration (MIC) was determined anaerobically in a 96 well-plate format. Plates were setup such that each individual well, when brought to a final volume of 100 uL following inoculation, had the following component levels (corresponding to synthetic minimal glucose medium (SD) standard media without vitamins):20 g/L dextrose, 5 g/L ammonium sulfate, 850 mg/L potassium phosphate monobasic, 150 mg/L potassium phosphate dibasic, 500 mg/L magnesium sulfate, 100 mg/L sodium chloride, 100 mg/L calcium chloride, 500 ug/L boric acid, 40 ug/L copper sulfate, 100 ug/L potassium iodide, 200 ug/L ferric chloride, 400 ug/L manganese sulfate, 200 ug/L sodium molybdate, and 400 ug/L zinc sulfate. Overnight cultures of strains were grown in triplicate in 5 mL SD media with vitamins (Methods in Enzymology vol. 350, page 17 (2002)). A 1% (v/v) inoculum was introduced into a 5 ml culture of SD minimal media without vitamins. After the cells reached mid-exponential phase, the culture was diluted to an $OD_{600}$ of 0.200. The cells were further diluted 1:5 and a 10 μL aliquot was used to inoculate each well of a 96 well plate ($\sim 10^4$ cells per well) to total volume of 100 uL. The plate was arranged to measure the growth of variable strains or growth conditions in increasing 3-HP concentrations, 0 to 60 g/L, in 5 g/L increments. Plates were incubated for 72 hours at 30 C. The minimum inhibitory 3-HP concentration and maximum 3-HP concentration corresponding to visible cell growth (OD~0.1) was recorded after 72 hours. For cases when MIC >60 g/L, assessments were performed in plates with extended 3-HP concentrations (0-100 g/L, in 5 g/L increments). Plates were sealed in biobag anaerobic chambers that contained gas generators for anaerobic conditions and incubated for 72 hours at 30 C. The minimum inhibitory 3-HP concentration and maximum 3-HP concentration corresponding to visible cell growth (OD~0.1) was recorded after 72 hours. For cases when MIC >60 g/L, assessments were performed in plates with extended 3-HP concentrations (0-100 g/L, in 5 g/L increments).

TABLE 52

Yeast Supplement Results Under Aerobic Conditions

| | Strain Name | Media | Supplements (Group) | Average MIC Assay Result (g/L 3-HP) | S.D. | MIC Assay Number | % Increase Over Control |
|---|---|---|---|---|---|---|---|
| CONTROLS | S288C | SD | none | 45 | 2.5 | ≥3 | — |
| | S288C | SC | none | 60 | <2.5 | ≥3 | 33 |
| | S288C | SD | Tryptophan (A) | 54 | 17.4 | ≥3 | 20 |
| | S288C | SD | Shikimate (A) | 80 | <2.5 | ≥3 | 78 |
| | S288C | SD | Chorismate Group Mix (A) | 80 | <2.5 | ≥3 | 78 |
| | S288C | SD | Glycine (B) | 50 | 11.0 | ≥3 | 11 |
| | S288C | SD | Methionine (B) | 72 | 16.9 | ≥3 | 59 |
| | S288C | SD | 2-oxobutyrate (B) | 50 | <2.5 | ≥3 | 11 |
| | S288C | SD | Aspartate | 57 | 2.9 | ≥3 | 26 |
| | S288C | SD | Homocysteine Group Mix (B) | 87 | 5.8 | ≥3 | 93 |
| | S288C | SD | Putrescine(C) | 55 | 16.4 | ≥3 | 22 |
| | S288C | SD | Citrulline (C) | 58 | 21.4 | ≥3 | 28 |
| Supplement Combinations | | | | | | | |
| Control | S288C | SD | none | 45 | 2.5 | ≥3 | — |
| | S288C | SD | Tyrosine (A), Methionine (B), Putrescine (C), Lysine (D) | 77 | 4.7 | ≥3 | 70 |
| | S288C | SD | Methionine (B), Ornithine (C) | 80 | 0.0 | ≥3 | 78 |
| | S288C | SD | Homocysteine (B), Spermidine (C) | 77 | 4.7 | ≥3 | 70 |
| | S288C | SD | Tyrosine (A), Bicarbonate (C), Lysine (D) | 70 | <2.5 | ≥3 | 56 |
| | S288C | SD | Tyrosine (A), Bicarbonate (C), Uracil (E) | 67 | 4.7 | ≥3 | 48 |
| | S288C | SD | Methionine (B), Spermidine (C), Lysine (D) | 77 | 4.7 | ≥3 | 70 |

TABLE 52-continued

Yeast Supplement Results Under Aerobic Conditions

| Strain Name | Media | Supplements (Group) | Average MIC Assay Result (g/L 3-HP) | S.D. | MIC Assay Number | % Increase Over Control |
|---|---|---|---|---|---|---|
| S288C | SD | Methionine (B), Bicarbonate (C), Lysine (D) | 70 | <2.5 | ≥3 | 56 |
| S288C | SD | Methionine (B), Bicarbonate (C), Uracil (E) | 77 | 4.7 | ≥3 | 70 |
| S288C | SD | Methionine (B), Bicarbonate (C), Citrate (F) | 50 | <2.5 | ≥3 | 11 |
| S288C | SD | Putrescine (C), Lysine (D) | 57 | 4.7 | ≥3 | 26 |
| S288C | SD | Tyrosine (A), Methionine (B), Putrescine (C), Lysine (D), Uracil (E), Citrate (F) | 77 | 4.7 | ≥3 | 70 |
| S288C | SD | Tyrosine (A), Putrescine (C) | 77 | 4.7 | ≥3 | 70 |
| S288C | SD | Tetrahydrofolate (A), Spermidine (C) | 70 | <2.5 | ≥3 | 56 |
| S288C | SD | Homocysteine (B), Putrescine (C) | 80 | <2.5 | ≥3 | 78 |
| S288C | SD | Spermidine (C), Lysine (D) | 70 | <2.5 | ≥3 | 56 |
| S288C | SD | Bicarbonate (C), Citrate (F) | 50 | <2.5 | ≥3 | 11 |
| S288C | SD | Tyrosine (A), Bicarbonate (C), Citrate (F) | 50 | <2.5 | ≥3 | 11 |
| S288C | SD | Methionine (B), Spermidine (C), Citrate (F) | 67 | 4.7 | ≥3 | 48 |
| S288C | SD | Homocysteine (B), Bicarbonate (C), Uracil (E) | 60 | <2.5 | ≥3 | 33 |

TABLE 53

Yeast Supplement Results Under Anaerobic Conditions

| | Strain Name | Media | Supplements (Group) | Average MIC Assay Result (g/L 3-HP) | S.D. | MIC Assay Number | % Increase Over Control |
|---|---|---|---|---|---|---|---|
| CONTROLS | S288C | SD | none | 38 | 2.7 | ≥3 | — |
| | S288C | SD | Phenylalanine (A) | 38 | 2.9 | ≥3 | 2 |
| | S288C | SD | Tryptophan (A) | 55 | 5.5 | ≥3 | 47 |
| | S288C | SD | Shikimate (A) | 60 | <2.5 | ≥3 | 60 |
| | S288C | SD | Chorismate Group Mix (A) | 48 | 4.1 | ≥3 | 29 |
| | S288C | SD | Homocysteine (B) | 40 | <2.5 | ≥3 | 7 |
| | S288C | SD | Isoleucine (B) | 38 | 2.9 | ≥3 | 2 |
| | S288C | SD | Serine (B) | 45 | <2.5 | ≥3 | 20 |
| | S288C | SD | Glycine (B) | 60 | <2.5 | ≥3 | 60 |
| | S288C | SD | Methionine (B) | 100 | <2.5 | ≥3 | 167 |
| | S288C | SD | Threonine (B) | 38 | 2.9 | ≥3 | 2 |
| | S288C | SD | 2-oxobutyrate (B) | 38 | 2.9 | ≥3 | 2 |
| | S288C | SD | Homocysteine Group Mix (B) | 100 | <2.5 | ≥3 | 167 |
| | S288C | SD | Putrescine(C) | 58 | 4.1 | ≥3 | 56 |
| | S288C | SD | Cadaverine (C) | 60 | 4.1 | ≥3 | 60 |
| | S288C | SD | Spermidine (C) | 60 | <2.5 | ≥3 | 60 |
| | S288C | SD | Citrulline (C) | 97 | 5.8 | ≥3 | 158 |
| | S288C | SD | Bicarbonate (C) | 90 | <2.5 | ≥3 | 140 |
| | S288C | SD | Polyamine Group Mix (C) | 42 | 2.9 | ≥3 | 11 |
| | S288C | SD | Lysine (D) | 45 | <2.5 | ≥3 | 20 |
| Supplement Combinations | | | | | | | |
| Control | S288C | SD | none | 38 | 2.7 | ≥3 | 0 |
| | S288C | SD | Isoleucine (B), Bicarbonate (C), Lysine (D) | 67 | <2.5 | ≥3 | 78 |
| | S288C | SD | Homocysteine (B), Bicarbonate (C), Lysine (D) | 80 | <2.5 | ≥3 | 113 |
| | S288C | SD | Tyrosine (A), Methionine (B), Putrescine (C), Lysine (D) | 55 | 4.7 | ≥3 | 47 |
| | S288C | SD | Methionine (B), Putrescine (C) | 55 | <2.5 | ≥3 | 47 |
| | S288C | SD | Methionine (B), Ornithine (C) | 50 | <2.5 | ≥3 | 33 |
| | S288C | SD | Homocysteine (B), Spermidine (C) | 40 | 4.7 | ≥3 | 7 |
| | S288C | SD | Tyrosine (A), Bicarbonate (C), Lysine (D) | 70 | <2.5 | ≥3 | 87 |
| | S288C | SD | Tyrosine (A), Bicarbonate (C), Uracil (E) | 50 | 4.7 | ≥3 | 33 |

TABLE 53-continued

Yeast Supplement Results Under Anaerobic Conditions

| Strain Name | Media | Supplements (Group) | Average MIC Assay Result (g/L 3-HP) | S.D. | MIC Assay Number | % Increase Over Control |
|---|---|---|---|---|---|---|
| S288C | SD | Methionine (B), Spermidine (C), Lysine (D) | 100 | 4.7 | ≥3 | 167 |
| S288C | SD | Methionine (B), Bicarbonate (C), Lysine (D) | 80 | <2.5 | ≥3 | 113 |
| S288C | SD | Methionine (B), Bicarbonate (C), Uracil (E) | 78 | 4.7 | ≥3 | 107 |
| S288C | SD | Methionine (B), Bicarbonate (C), Citrate (F) | 73 | <2.5 | ≥3 | 93 |
| S288C | SD | Homocysteine (B), Bicarbonate (C) | 77 | <2.5 | ≥3 | 104 |
| S288C | SD | Putrescine (C), Lysine (D) | 77 | <2.5 | ≥3 | 104 |
| S288C | SD | Tyrosine (A), Methionine (B), Putrescine (C), Lysine (D), Uracil (E), Citrate (F) | 68 | 4.7 | ≥3 | 82 |
| S288C | SD | Tyrosine (A), Putrescine (C) | 57 | 4.7 | ≥3 | 51 |
| S288C | SD | Tyrosine (A), Spermidine (C) | 60 | 4.7 | ≥3 | 60 |
| S288C | SD | Tetrahydrofolate (A), Spermidine (C) | 50 | <2.5 | ≥3 | 33 |
| S288C | SD | Methionine (B), Spermidine (C) | 50 | <2.5 | ≥3 | 33 |
| S288C | SD | Homocysteine (B), Putrescine (C) | 100 | <2.5 | ≥3 | 167 |
| S288C | SD | Spermidine (C), Lysine (D) | 100 | <2.5 | ≥3 | 167 |
| S288C | SD | Bicarbonate (C), Citrate (F) | 50 | <2.5 | ≥3 | 33 |
| S288C | SD | Tyrosine (A), Methionine (B), Uracil (E) | 40 | <2.5 | ≥3 | 7 |
| S288C | SD | Tyrosine (A), Bicarbonate (C), Citrate (F) | 50 | <2.5 | ≥3 | 33 |
| S288C | SD | Methionine (B), Spermidine (C), Citrate (F) | 50 | <2.5 | ≥3 | 33 |
| S288C | SD | Homocysteine (B), Bicarbonate (C), Uracil (E) | 57 | 4.7 | ≥3 | 51 |

TABLE 54

Yeast Genetic Modification Results Under Aerobic Conditions

| Strain Name | Media | Group Represented | Parent | Vector based Genetic Modifications | MIC Assay Result (g/L 3-HP) | S.D. | MIC Assay Number | % Increase Over Control |
|---|---|---|---|---|---|---|---|---|
| YX-CJR-001 | SD | none | BY4709 | pRS426 EV | 40 | <2.5 | ≥3 | — |
| YX-CJR-002 | SD | C | BY4709 | pYes2.1-spe3 | 50 | <2.5 | ≥3 | 25 |
| YX-CJR-003 | SD | B | BY4709 | pYes2.1-hom2 | 47 | <2.5 | ≥3 | 17 |
| YX-CJR-005 | SD | B | BY4709 | pYes2.1-Met6 | 50 | <2.5 | ≥3 | 25 |
| YX-CJR-006 | SD | B | BY4709 | pYes2.1-Ilv2 | 57 | <2.5 | ≥3 | 42 |
| YX-CJR-010 | SD | B | BY4709 | pyes2.1-Thr1 | 60 | <2.5 | ≥3 | 50 |
| YX-CJR-014 | SD | C | BY4709 | pye s2.1-arg2 | 60 | <2.5 | ≥3 | 50 |
| YX-CJR-017 | SD | A | BY4709 | pyes2.1-Aro7 | 70 | <2.5 | ≥3 | 75 |
| YX-022 | SD | A, B | BY4722 | pyes2.1-Aro3 pRS425-ILV6 | 60 | <2.5 | ≥3 | 50 |

TABLE 55

Yeast Genetic Modification Results Under Anaerobic Conditions

| Strain Name | Media | Group Represented | Parent | Vector based Genetic Modifications | MIC Assay Result (g/L 3-HP) | P-value | MIC Assay Number | % Increase Over Control |
|---|---|---|---|---|---|---|---|---|
| YX-CJR-001 | SD | none | BY4709 | pRS426 EV | 40 | <0.1 | ≥3 | — |
| YX-CJR-005 | SD | B | BY4709 | pYes2.1-Met6 | 60 | <0.1 | ≥3 | 50 |
| YX-CJR-007 | SD | B | BY4709 | pyes2.1-ILV6 | 50 | <0.1 | ≥3 | 25 |
| YX-CJR-008 | SD | B | BY4709 | pyes2.1-ILV1 | 60 | <0.1 | ≥3 | 50 |
| YX-CJR-010 | SD | B | BY4709 | pyes2.1-Thr1 | 50 | <0.1 | ≥3 | 25 |
| YX-CJR-011 | SD | B | BY4709 | pyes2.1-Ser2 | 50 | <0.1 | ≥3 | 25 |
| YX-CJR-013 | SD | B | BY4709 | pyes2.1-ser3 | 50 | <0.1 | ≥3 | 25 |
| YX-CJR-014 | SD | C | BY4709 | pyes2.1-arg2 | 50 | <0.1 | ≥3 | 25 |
| YX-CJR-015 | SD | E | BY4709 | pyes2.1-RNR1 | 50 | <0.1 | ≥3 | 25 |

TABLE 55-continued

Yeast Genetic Modification Results Under Anaerobic Conditions

| Strain Name | Media | Group Represented | Parent | Vector based Genetic Modifications | MIC Assay Result (g/L 3-HP) | P-value | MIC Assay Number | % Increase Over Control |
|---|---|---|---|---|---|---|---|---|
| YX-CJR-016 | SD | A | BY4709 | pyes2.1-Aro3 | 50 | <0.1 | ≥3 | 25 |
| YX-CJR-018 | SD | A | BY4709 | pyes2.1-Tyr1 | 50 | <0.1 | ≥3 | 25 |
| YX-CJR-021 | SD | A | BY4709 | pYes2.1-Trp1 | 50 | <0.1 | ≥3 | 25 |
| YX-022 | SD | A, B | BY4722 | pyes2.1-Aro3 pRS425-ILV6 | 50 | <0.1 | ≥3 | 25 |

TABLE 56

C. necator Supplement Results under Aerobic Conditions

| Strain Name | Media | Supplements | Supplement Codes | average MIC Assay Result (g/L 3-HP) | P-value | MIC Assay Number | % Increase Over Control |
|---|---|---|---|---|---|---|---|
| DSM 428 | FGN | none | none | 15 | <0.1 | ≥3 | — |
| DSM 542 | EZ Rich | none | none | 60 | <0.1 | ≥3 | 200 |
| DSM 542 | FGN | none | none | 15 | <0.1 | ≥3 | 0 |
| DSM 542 | FGN | Homocysteine Bicarbonate, Lysine | B, C ,D | 30 | <0.1 | ≥3 | 100 |
| DSM 542 | FGN | Tyrosine , Methionine, Putrescine, Lysine | A, B, C, D | 30 | <0.1 | ≥3 | 100 |
| DSM 542 | FGN | Methionine, Putrescine | B, C | 25 | <0.1 | ≥3 | 67 |
| DSM 542 | FGN | Methionine, Ornithine | B, C | 30 | <0.1 | ≥3 | 100 |
| DSM 542 | FGN | Homocysteine, Spermidine | B, C | 25 | <0.1 | ≥3 | 67 |
| DSM 542 | FGN | Methionine, Bicarbonate, Citrate | B, C ,F | 25 | <0.1 | ≥3 | 67 |
| DSM 542 | FGN | Homocysteine, Bicarbonate | B, C | 25 | <0.1 | ≥3 | 67 |
| DSM 542 | FGN | Homocysteine Group Mix | B | 20 | <0.1 | ≥3 | 33 |

Example 62

Evaluation of 3HPTGC-Related Supplements in *Cupriavidus necator*

The effect of supplementation on 3HP tolerance in *C. necator* was determined by MIC evaluations using the methods described in the Common Methods Section. Supplements tested are listed in the Supplements Table.

MIC results under aerobic condition for *C. necator* are provided in Table 56. This data, which includes single and multiple supplement additions, demonstrates improvement in 3-HP tolerance in these culture systems based on the MIC evaluations.

Example 63

Additional Example of 3HPTGC Tolerance-Directed Genetic Modification(s) in Combination with 3-HP Production Genetic Modification(s)

In addition to Example 42, which provides a general example to combine tolerance and 3-HP production genetic modifications to obtain a desired genetically modified microorganism suitable for use to produce 3-HP, and in view of the examples following Example 43, and considering additional disclosure herein, and methods known to those skilled in the art (e.g., Sambrook and Russell, 2001, incorporated into this example for its methods of genetic modifications), this example provides a microorganism species genetically modified to comprise one or more genetic modifications of the 3HPTGC to provide an increase tolerance to 3-HP (which may be assessed by any metric such as those discussed herein) and one or more genetic modifications to increase 3-HP production (such as of a 3-HP production pathway such as those disclosed herein).

The so-genetically modified microorganism may be evaluated both for tolerance to and production of 3-HP under varying conditions including oxygen content of the culture system and nutrient composition of the media.

In various aspects of this example, multiple sets of genetic modifications are made and are compared to identify one or more genetically modified microorganisms that comprise desired attributes and/or metrics for increased 3-HP tolerance and production.

Example 64

Introduction of Genetic Modification Encoding the Irok Sequence Combined with 3HPTGC Genetic Modifications Example 45 describes Irok, a peptide comprised of 21 amino acids, and its 3-HP tolerance improving effect when a plasmid encoding it is introduced into an *E. coli* strain and evaluated under microaerobic conditions. Considering the disclosure herein regarding the 3HPTGC, and methods known to those skilled in the art (e.g., Sambrook and Russell, 2001, incorporated into this example for its methods of genetic modifications), a microorganism species is genetically modified to comprise a nucleic acid sequence that encodes the IroK peptide sequence and one or more genetic modifications of the 3HPTGC, collectively to provide an increase tolerance to 3-HP. Such increase in 3-HP tolerance may be assessed by any metric such as those discussed herein.

Thus, based on the results various genetic modification combinations that include representation from two or more of the Groups A-E may be evaluated, and employed, in a microorganism to achieve a desired elevated tolerance to 3-HP. The tables above show the results of particular genetic modification combinations that include combinations from these groups. Also, additional genetic modifications may be provided from Group F. As described elsewhere herein, any such combination may be combined with other genetic modifications that may include one or more of: 3-HP bio-production pathways to provide and/or increase 3-HP synthesis and accumulation by the recombinant microorganism, and deletions or other modifications to direct more metabolic resources (e.g., carbon and energy) into 3-HP bio-production, as well as other genetic modifications directed to modulate flux into the fatty acid synthase system.

The following are non-limiting general prophetic examples directed to practicing the present invention in other microorganism species.

General Prophetic Example 65

Improvement of 3-HP Tolerance and/or
Bio-Production in *Rhodococcus erythropolis*

A series of *E. coli-Rhodococcus* shuttle vectors are available for expression in *R. erythropolis*, including, but not limited to, pRhBR17 and pDA71 (Kostichka et al., Appl. Microbiol. Biotechnol. 62:61-68 (2003)). Additionally, a series of promoters are available for heterologous gene expression in *R. erythropolis* (see for example Nakashima et al., Appl. Environ. Microbiol. 70:5557-5568 (2004), and Tao et al., Appl. Microbiol. Biotechnol. 2005, DOI 10.1007/s00253-005-0064). Targeted gene disruption of chromosomal genes in *R. erythropolis* may be created using the method described by Tao et al., supra, and Brans et al. (Appl. Environ. Microbiol. 66: 2029-2036 (2000)). These published resources are incorporated by reference for their respective indicated teachings and compositions.

The nucleic acid sequences required for providing an increase in 3-HP tolerance, as described herein, optionally with nucleic acid sequences to provide and/or improve a 3-HP biosynthesis pathway, are cloned initially in pDA71 or pRhBR71 and transformed into *E. coli*. The vectors are then transformed into *R. erythropolis* by electroporation, as described by Kostichka et al., supra. The recombinants are grown in synthetic medium containing glucose and the tolerance to and/or bio-production of 3-HP are followed using methods known in the art or described herein.

General Prophetic Example 66

Improvement of 3-HP Tolerance and/or
Bio-Production in *B. licheniformis*

Most of the plasmids and shuttle vectors that replicate in *B. subtilis* are used to transform *B. licheniformis* by either protoplast transformation or electroporation. The nucleic acid sequences required for improvement of 3-HP tolerance, and/or for 3-HP biosynthesis are isolated from various sources, codon optimized as appropriate, and cloned in plasmids pBE20 or pBE60 derivatives (Nagaraj an et al., Gene 114: 121-126 (1992)). Methods to transform *B. licheniformis* are known in the art (for example see Fleming et al. Appl. Environ. Microbiol., 61(11):3775-3780 (1995)). These published resources are incorporated by reference for their respective indicated teachings and compositions.

The plasmids constructed for expression in *B. subtilis* are transformed into *B. licheniformis* to produce a recombinant microorganism that then demonstrates improved 3-HP tolerance, and, optionally, 3-HP bio-production.

General Prophetic Example 67

Improvement of 3-HP Tolerance and/or
Bio-Production in *Paenibacillus macerans*

Plasmids are constructed as described herein for expression in *B. subtilis* and used to transform *Paenibacillus macerans* by protoplast transformation to produce a recombinant microorganism that demonstrates improved 3-HP tolerance, and, optionally, 3-HP bio-production.

General Prophetic Example 68

Expression of 3-HP Tolerance and/or Bio-Production
in *Alcaligenes* (*Ralstonia*) *eutrophus* (Currently
Referred to as *Cupriavidus necator*)

Methods for gene expression and creation of mutations in *Alcaligenes eutrophus* are known in the art (see for example Taghavi et al., Appl. Environ. Microbiol., 60(10):3585-3591 (1994)). This published resource is incorporated by reference for its indicated teachings and compositions. Any of the nucleic acid sequences identified to improve 3-HP tolerance, and/or for 3-HP biosynthesis are isolated from various sources, codon optimized as appropriate, and cloned in any of the broad host range vectors described herein, and electroporated to generate recombinant microorganisms that demonstrate improved 3-HP tolerance, and, optionally, 3-HP bio-production. The poly(hydroxybutyrate) pathway in *Alcaligenes* has been described in detail, a variety of genetic techniques to modify the *Alcaligenes eutrophus* genome is known, and those tools can be applied for engineering a 3-HP toleragenic or, optionally, a 3-HP-gena-toleragenic recombinant microorganism.

General Prophetic Example 69

Improvement of 3-HP Tolerance and/or
Bio-Production in *Pseudomonas putida*

Methods for gene expression in *Pseudomonas putida* are known in the art (see for example Ben-Bassat et al., U.S. Pat. No. 6,586,229, which is incorporated herein by reference for these teachings). Any of the nucleic acid sequences identified to improve 3-HP tolerance, and/or for 3-HP biosynthesis are isolated from various sources, codon optimized as appropriate, and cloned in any of the broad host range vectors described herein, and electroporated to generate recombinant microorganisms that demonstrate improved 3-HP tolerance, and, optionally, 3-HP biosynthetic production. For example, these nucleic acid sequences are inserted into pUCP18 and this ligated DNA are electroporated into electrocompetent *Pseudomonas putida* KT2440 cells to generate recombinant *P. putida* microorganisms that exhibit increased 3-HP tolerance and optionally also comprise 3-HP biosynthesis pathways comprised at least in part of introduced nucleic acid sequences.

General Prophetic Example 70

Improvement of 3-HP Tolerance and/or
Bio-Production in *Lactobacillus plantarum*

The *Lactobacillus* genus belongs to the Lactobacillales family and many plasmids and vectors used in the transformation of *Bacillus subtilis* and *Streptococcus* are used for *Lactobacillus*. Non-limiting examples of suitable vectors include pAM.beta.1 and derivatives thereof (Renault et al., Gene 183:175-182 (1996); and O'Sullivan et al., Gene 137: 227-231 (1993)); pMBB1 and pHW800, a derivative of pMBB1 (Wyckoff et al. Appl. Environ. Microbiol. 62:1481-1486 (1996)); pMG1, a conjugative plasmid (Tanimoto et al., J. Bacteriol. 184:5800-5804 (2002)); pNZ9520 (Kleerebezem et al., Appl. Environ. Microbiol. 63:4581-4584 (1997)); pAM401 (Fujimoto et al., Appl. Environ. Microbiol. 67:1262-1267 (2001)); and pAT392 (Arthur et al., Antimicrob. Agents Chemother. 38:1899-1903 (1994)). Several plasmids from *Lactobacillus plantarum* have also been reported (e.g., van Kranenburg R, Golic N, Bongers R, Leer R J, de Vos W M, Siezen R J, Kleerebezem M. Appl. Environ. Microbiol. 2005 March; 71(3): 1223-1230).

General Prophetic Example 71

Improvement of 3-HP Tolerance and/or Bio-production in *Enterococcus faecium*, *Enterococcus gallinarium*, and *Enterococcus faecalis*

The *Enterococcus* genus belongs to the Lactobacillales family and many plasmids and vectors used in the transformation of *Lactobacillus*, *Bacillus subtilis*, and *Streptococcus* are used for *Enterococcus*. Non-limiting examples of suitable vectors include pAM.beta.1 and derivatives thereof (Renault et al., Gene 183:175-182 (1996); and O'Sullivan et al., Gene 137:227-231 (1993)); pMBB1 and pHW800, a derivative of pMBB1 (Wyckoff et al. Appl. Environ. Microbiol. 62:1481-1486 (1996)); pMG1, a conjugative plasmid (Tanimoto et al., J. Bacteriol. 184:5800-5804 (2002)); pNZ9520 (Kleerebezem et al., Appl. Environ. Microbiol. 63:4581-4584 (1997)); pAM401 (Fujimoto et al., Appl. Environ. Microbiol. 67:1262-1267 (2001)); and pAT392 (Arthur et al., Antimicrob. Agents Chemother. 38:1899-1903 (1994)). Expression vectors for *E. faecalis* using the nisA gene from *Lactococcus* may also be used (Eichenbaum et al., Appl. Environ. Microbiol. 64:2763-2769 (1998). Additionally, vectors for gene replacement in the *E. faecium* chromosome are used (Nallaapareddy et al., Appl. Environ. Microbiol. 72:334-345 (2006)).

For each of the General Prophetic Examples 65-71, the following 3-HP bio-production comparison may be incorporated thereto: Using analytical methods for 3-HP such as are described in Subsection III of Common Methods Section, 3-HP is obtained in a measurable quantity at the conclusion of a respective bio-production event conducted with the respective recombinant microorganism (see types of bio-production events, incorporated by reference into each respective General Prophetic Example). That measurable quantity is substantially greater than a quantity of 3-HP produced in a control bio-production event using a suitable respective control microorganism lacking the functional 3-HP pathway so provided in the respective General Prophetic Example. Tolerance improvements also may be assessed by any recognized comparative measurement technique, such as by using a MIC protocol provided in the Common Methods Section.

Common Methods Section

All methods in this Section are provided for incorporation into the Examples where so referenced.

Subsection I. Microorganism Species and Strains, Cultures, and Growth Media

Bacterial species, that may be utilized as needed, are as follows:

*Acinetobacter calcoaceticus* (DSMZ #1139) is obtained from the German Collection of Microorganisms and Cell Cultures (Braunschweig, Germany) as a vacuum dried culture. Cultures are then resuspended in Brain Heart Infusion (BHI) Broth (RPI Corp, Mt. Prospect, Ill., USA). Serial dilutions of the resuspended *A. calcoaceticus* culture are made into BHI and are allowed to grow for aerobically for 48 hours at 37° C. at 250 rpm until saturated.

*Bacillus subtilis* is a gift from the Gill lab (University of Colorado at Boulder) and is obtained as an actively growing culture. Serial dilutions of the actively growing *B. subtilis* culture are made into Luria Broth (RPI Corp, Mt. Prospect, Ill., USA) and are allowed to grow for aerobically for 24 hours at 37° C. at 250 rpm until saturated.

*Chlorobium limicola* (DSMZ#245) is obtained from the German Collection of Microorganisms and Cell Cultures (Braunschweig, Germany) as a vacuum dried culture. Cultures are then resuspended using Pfennig's Medium I and II (#28 and 29) as described per DSMZ instructions. *C. limicola* is grown at 25° C. under constant vortexing.

*Citrobacter braakii* (DSMZ #30040) is obtained from the German Collection of Microorganisms and Cell Cultures (Braunschweig, Germany) as a vacuum dried culture. Cultures are then resuspended in Brain Heart Infusion(BHI) Broth (RPI Corp, Mt. Prospect, Ill., USA). Serial dilutions of the resuspended *C. braakii* culture are made into BHI and are allowed to grow for aerobically for 48 hours at 30° C. at 250 rpm until saturated.

*Clostridium acetobutylicum* (DSMZ #792) is obtained from the German Collection of Microorganisms and Cell Cultures (Braunschweig, Germany) as a vacuum dried culture. Cultures are then resuspended in *Clostridium acetobutylicum* medium (#411) as described per DSMZ instructions. *C. acetobutylicum* is grown anaerobically at 37° C. at 250 rpm until saturated.

*Clostridium aminobutyricum* (DSMZ #2634) is obtained from the German Collection of Microorganisms and Cell Cultures (Braunschweig, Germany) as a vacuum dried culture. Cultures are then resuspended in *Clostridium aminobutyricum* medium (#286) as described per DSMZ instructions. *C. aminobutyricum* is grown anaerobically at 37° C. at 250 rpm until saturated.

*Clostridium kluyveri* (DSMZ #555) is obtained from the German Collection of Microorganisms and Cell Cultures (Braunschweig, Germany) as an actively growing culture. Serial dilutions of *C. kluyveri* culture are made into *Clostridium kluyveri* medium (#286) as described per DSMZ instructions. *C. kluyveri* is grown anaerobically at 37° C. at 250 rpm until saturated.

*Cupriavidus metallidurans* (DMSZ #2839) is obtained from the German Collection of Microorganisms and Cell Cultures (Braunschweig, Germany) as a vacuum dried culture. Cultures are then resuspended in Brain Heart Infusion (BHI) Broth (RPI Corp, Mt. Prospect, Ill., USA). Serial dilutions of the resuspended *C. metallidurans* culture are made into BHI and are allowed to grow for aerobically for 48 hours at 30° C. at 250 rpm until saturated.

*Cupriavidus necator* (DSMZ #428) is obtained from the German Collection of Microorganisms and Cell Cultures (Braunschweig, Germany) as a vacuum dried culture. Cultures are then resuspended in Brain Heart Infusion (BHI) Broth (RPI Corp, Mt. Prospect, Ill., USA). Serial dilutions of the resuspended *C. necator* culture are made into BHI and are allowed to grow for aerobically for 48 hours at 30° C. at 250 rpm until saturated. As noted elsewhere, previous names for this species are *Alcaligenes eutrophus* and *Ralstonia eutrophus*.

*Desulfovibrio fructosovorans* (DSMZ #3604) is obtained from the German Collection of Microorganisms and Cell Cultures (Braunschweig, Germany) as a vacuum dried culture. Cultures are then resuspended in *Desulfovibrio fruc-*

*tosovorans* medium (#63) as described per DSMZ instructions. *D. fructosovorans* is grown anaerobically at 37° C. at 250 rpm until saturated.

*Escherichia coli* Crooks (DSMZ#1576) is obtained from the German Collection of Microorganisms and Cell Cultures (Braunschweig, Germany) as a vacuum dried culture. Cultures are then resuspended in Brain Heart Infusion (BHI) Broth (RPI Corp, Mt. Prospect, Ill., USA). Serial dilutions of the resuspended *E. coli* Crooks culture are made into BHI and are allowed to grow for aerobically for 48 hours at 37° C. at 250 rpm until saturated.

*Escherichia coli* K12 is a gift from the Gill lab (University of Colorado at Boulder) and is obtained as an actively growing culture. Serial dilutions of the actively growing *E. coli* K12 culture are made into Luria Broth (RPI Corp, Mt. Prospect, Ill., USA) and are allowed to grow for aerobically for 24 hours at 37° C. at 250 rpm until saturated.

*Halobacterium salinarum* (DSMZ#1576) is obtained from the German Collection of Microorganisms and Cell Cultures (Braunschweig, Germany) as a vacuum dried culture. Cultures are then resuspended in *Halobacterium* medium (#97) as described per DSMZ instructions. *H. salinarum* is grown aerobically at 37° C. at 250 rpm until saturated.

*Lactobacillus delbrueckii* (#4335) is obtained from WYEAST USA (Odell, Oreg., USA) as an actively growing culture. Serial dilutions of the actively growing *L. delbrueckii* culture are made into Brain Heart Infusion (BHI) broth (RPI Corp, Mt. Prospect, Ill., USA) and are allowed to grow for aerobically for 24 hours at 30° C. at 250 rpm until saturated.

*Metallosphaera sedula* (DSMZ #5348) is obtained from the German Collection of Microorganisms and Cell Cultures (Braunschweig, Germany) as an actively growing culture. Serial dilutions of *M. sedula* culture are made into *Metallosphaera* medium (#485) as described per DSMZ instructions. *M. sedula* is grown aerobically at 65° C. at 250 rpm until saturated.

*Propionibacterium freudenreichii* subsp. *shermanii* (DSMZ#4902) is obtained from the German Collection of Microorganisms and Cell Cultures (Braunschweig, Germany) as a vacuum dried culture. Cultures are then resuspended in PYG-medium (#104) as described per DSMZ instructions. *P. freudenreichii* subsp. *shermanii* is grown anaerobically at 30° C. at 250 rpm until saturated.

*Pseudomonas putida* is a gift from the Gill lab (University of Colorado at Boulder) and is obtained as an actively growing culture. Serial dilutions of the actively growing *P. putida* culture are made into Luria Broth (RPI Corp, Mt. Prospect, Ill., USA) and are allowed to grow for aerobically for 24 hours at 37° C. at 250 rpm until saturated.

*Streptococcus mutans* (DSMZ#6178) is obtained from the German Collection of Microorganisms and Cell Cultures (Braunschweig, Germany) as a vacuum dried culture. Cultures are then resuspended in Luria Broth (RPI Corp, Mt. Prospect, Ill., USA). *S. mutans* is grown aerobically at 37° C. at 250 rpm until saturated.

The following non-limiting strains may also be used as starting strains in the Examples: DF40 Hfr(PO2A), garB10, fhuA22, ompF627(T2R), fadL701(T2R), relA1, pitA10, spoT1, rrnB-2, pgi-2, mcrB1, creC510, BW25113 F-, Δ(araD-araB)567, ΔlacZ4787(::rrnB-3), λ-, rph-1, Δ(rhaD-rhaB)568, hsdR514, JP111 Hfr(PO1), galE45(GalS), λ-, fabI392(ts), relA1, spoT1, thi-1. These strains possess recognized genetic modifications, and are available from public culture sources such as the Yale *Coli* Genetic Stock Collection (New Haven, Conn. USA). Strains developed from these strains are described in the Examples.

Bacterial growth culture media and associated materials and conditions, are as follows:

Fed-batch medium contained (per liter): 10 g tryptone, 5 g yeast extract, 1.5 g NaCl, 2 g $Na_2HPO_4 \cdot 7H_2O$, 1 g $KH_2PO_4$, and glucose as indicated AM2 medium contained (per liter): 2.87 g $K_2HPO_4$, 1.50 g $KH_2PO_4$, 3.13 g $(NH_4)_2SO_4$, 0.15 g KCl, 1.5 mM $MgSO_4$, 0.1M K MOPS pH 7.2, 30 g glucose, and 1 ml trace Mineral Stock prepared as described in Martinez et al. Biotechnol Left 29:397-404 (2007)

AM2 Medium used in Fermenters for Initial Batch Medium (for Example 11)

| | |
|---|---|
| $K_2HPO_4$ | 2.87 g/L |
| $KH_2PO_4$ | 1.50 g/L |
| $(NH_4)_2SO_4$ | 3.13 g/L |
| KCl | 0.15 g/L |
| Glucose | 6.0 g/L |
| $MgSO_4$ | 0.18 g/L |
| AM2 Trace Metals Stock Solution | 1.0 ml/L |
| Calcium Pantothenate | 0.005 g/L |
| Ampicillin | 0.1 g/L |
| Kanamycin | 0.02 g/L |
| Chloramphenicol | 0.02 g/L |

Trace Metals Stock Solution for AM2 medium used in Fermenters

| | |
|---|---|
| Concentrated HCl | 10.0 ml/L |
| $FeCl_3 \cdot 6H_2O$ | 2.4 g/L |
| $CoCl_2 \cdot 6H_2O$ | 0.17 g/L |
| $CuCl_2 \cdot 2H_2O$ | 0.15 g/L |
| $ZnCl_2$ | 0.3 g/L |
| $Na_2MoO_4 \cdot 2H_2O$ | 0.3 g/L |
| $H_3BO_3$ | 0.07 g/L |
| $MnCl_2 \cdot 4H_2O$ | 0.5 g/L |

Concentration of glucose in glucose feed for AM2 vessels: 200 g/L glucose

Rich Medium used in Fermenters Initial Batch Medium (for Example 11)

| | |
|---|---|
| Tryptone | 10 g/L |
| Yeast Extract | 5 g/L |
| Glucose | 4 g/L |
| $Na_2HPO_4 \cdot 7H_2O$ | 2 g/L |
| $KH_2PO_4$ | 1 g/L |
| $MgSO_4$ | 2 g/L |
| Ampicillin | 0.1 g/L |
| Kanamycin | 0.02 g/L |
| Chloramphenicol | 0.02 g/L |

Feed Formulation for additional glucose feed for rich media

| | |
|---|---|
| Glucose | 200 g/L |
| $(NH_4)_2SO_4$ | 30 g/L |
| $KH_2PO_4$ | 7.5 g/L |
| Citric Acid | 3 g/L |
| $MgSO_4$ | 2.93 g/L |
| $FeSO_4 \cdot 7H_2O$ | 0.05 g/L |

SM3 minimal medium for *E. coli* (Final phosphate concentration=27.5 mM; Final N concentration=47.4 mM $NH_4^+$).

Components per liter: 700 mL DI water, 100 mL 10× SM3 Salts, 2 ml 1M $MgSO_4$, 1 ml 1000× Trace Mineral Stock, 60 mL 500 g/L glucose, 100 mL 0.1 M MOPS (pH 7.4), 0.1 mL of 1 M $CaCl_2$, Q.S. with DI water to 1000 mL, and 0.2 µm filter sterilize.

Preparation of Stock Solutions:

To make 10×SM3 Salts (1 L): 800 mL DI water, 28.7 g $K_2HPO_4$, 15 g $KH_2PO_4$, 31.3 g $(NH_4)_2SO_4$, 1.5 g KCl, 0.5 g Citric Acid (anhydrous), and Q.S. with DI water to 1000 mL.

To make 1000× Trace Mineral Stock (1 L): save in 50-ml portions at room temp

Per liter in 0.12M HCl (dilute 10 ml conc HCl into 1 liter water):2.4 g $FeCL_3.6H_2O$, 0.17 g $CoCl_2.6H_2O$, 0.15 g $CuCl_2.2H_2O$, 0.3 g $ZnCl_2$, 0.3 g $NaMoO_4.2H_2O$ (Molybdic acid, disodium salt, dihydrate), 0.07 g $H_3BO_3$, and 0.5 g $MnCl_2.4H_2O$.

To make 1M MOPS:209.3 g MOPS, dissolve in 700 ml water. Take 70-ml portions and adjust to desired pH with 50% KOH, adjust to 100 mL final volume, and 0.2 µm filter sterilize.

To make 1M $MgSO_4$:120.37 g dissolved in 1000 mL water.

To make 500 g/L (50%) glucose stock solution: 900 mL DI water, 500 g glucose, and Q.S. to 1000 mL.

Additional Growth Media Formulations are summarized as:

| | Ingredient | Concentration in FM3 | Concentration in FM4 | Concentration in FM5 |
|---|---|---|---|---|
| 1 | $K_2HPO_4$ | 2.63 g/L | 13.4 g/L | 2.63 g/L |
| 2 | $KH_2PO_4$ | 1.38 g/L | 3 g/L | 1.38 g/L |
| 3 | $(NH_4)_2SO_4$ | 13.88 g/L | 3 g/L | 3 g/L |
| 4 | NaCl | — | 0.5 g/L | — |
| 5 | Citric Acid•$H_2O$ | 2.19 g/L | 1.1 g/L | 2.19 g/L |
| 6 | Yeast Extract | 1.25 g/L | 1 g/L | 1 g/L |
| 7 | Antifoam 204 | 0.1 ml/L | 0.1 ml/L | 0.1 ml/L |
| 8 | Glucose | 30 g/L | 30 g/L | 30 g/L |
| 9 | $MgSO_4•7H_2O$ | 0.82 g/L | 0.48 g/L | 0.82 g/L |
| 10 | FM10 Trace Metals Stock Solution | 1.5 ml/L | 2 ml/L | 2 ml/L |
| 11 | Kanamycin | 35 mg/L | 35 mg/L | 35 mg/L |
| 12 | Chloramphenicol | 20 mg/L | 20 mg/L | 20 mg/L |

FM10: Trace Metals Stock Solution formulation:

| Ingredient | Concentration |
|---|---|
| Concentrated HCl | 10.0 ml/L |
| $CaCl_2•2H_2O$ | 49 g/L |
| $FeCl_3•6H_2O$ | 9.7 g/L |
| $CoCl_2•6H_2O$ | 0.4 g/L |
| $CuCl_2•2H_2O$ | 2.7 g/L |
| $ZnCl_2$ | 0.2 g/L |
| $Na_2MoO_4•2H_2O$ | 0.24 g/L |
| $H_3BO_3$ | 0.07 g/L |
| $MnCl_2•4H_2O$ | 0.36 g/L |

To make 1 L M9 minimal media:

M9 minimal media was made by combining 5×M9 salts, 1M $MgSO_4$, 20% glucose, 1M $CaCl_2$ and sterile deionized water. The 5×M9 salts are made by dissolving the following salts in deionized water to a final volume of 1 L: 64 g $Na_2HPO_4'7H_2O$, 15 g $KH_2PO_4$, 2.5 g NaCl, 5.0 g $NH_4Cl$. The salt solution was divided into 200 mL aliquots and sterilized by autoclaving for 15 minutes at 15 psi on the liquid cycle. A 1M solution of $MgSO_4$ and 1M $CaCl_2$ were made separately, then sterilized by autoclaving. The glucose was filter sterilized by passing it thought a 0.22 µm filter. All of the components are combined as follows to make 1 L of M9: 750 mL sterile water, 200 mL 5×M9 salts, 2 mL of 1M $MgSO_4$, 20 mL 20% glucose, 0.1 mL $CaCl_2$, Q.S. to a final volume of 1 L.

To make EZ Rich Media:

All media components were obtained from TEKnova (Hollister Calif. USA) and combined in the following volumes. 100 mL 10×MOPS mixture, 10 mL 0.132M $K_2$ $HPO_4$, 100 mL 10×ACGU, 200 mL 5× Supplement EZ, 10 mL 20% glucose, 580 mL sterile water.

Subsection II: Gel Preparation, DNA Separation, Extraction, Ligation, and Transformation Methods:

Molecular biology grade agarose (RPI Corp, Mt. Prospect, Ill., USA) is added to 1×TAE to make a 1% Agarose in TAE. To obtain 50×TAE add the following to 900 ml distilled $H_2O$:242 g Tris base (RPI Corp, Mt. Prospect, Ill., USA), 57.1 ml Glacial Acetic Acid (Sigma-Aldrich, St. Louis, Mo., USA), 18.6 g EDTA (Fisher Scientific, Pittsburgh, Pa. USA), and adjust volume to 1 L with additional distilled water. To obtain 1×TAE, add 20 mL of 50×TAE to 980 mL of distilled water. The agarose-TAE solution is then heated until boiling occurred and the agarose is fully dissolved. The solution is allowed to cool to 50° C. before 10 mg/mL ethidium bromide (Acros Organics, Morris Plains, N.J., USA) is added at a concentration of 5 ul per 100 mL of 1% agarose solution. Once the ethidium bromide is added, the solution is briefly mixed and poured into a gel casting tray with the appropriate number of combs (Idea Scientific Co., Minneapolis, Minn., USA) per sample analysis. DNA samples are then mixed accordingly with 5×TAE loading buffer. 5×TAE loading buffer consists of 5×TAE(diluted from 50×TAE as described herein), 20% glycerol (Acros Organics, Morris Plains, N.J., USA), 0.125% Bromophenol Blue (Alfa Aesar, Ward Hill, Mass., USA), and adjust volume to 50 mL with distilled water. Loaded gels are then run in gel rigs (Idea Scientific Co., Minneapolis, Minn., USA) filled with 1×TAE at a constant voltage of 125 volts for 25-30 minutes. At this point, the gels are removed from the gel boxes with voltage and visualized under a UV transilluminator (FOTODYNE Inc., Hartland, Wis., USA).

The DNA isolated through gel extraction is then extracted using the QIAquick Gel Extraction Kit following manufacturer's instructions (Qiagen (Valencia Calif. USA)). Similar methods are known to those skilled in the art.

The thus-extracted DNA then may be ligated into pSMART (Lucigen Corp, Middleton, Wis., USA), StrataClone (Stratagene, La Jolla, Calif., USA) or pCR2.1-TOPO TA (Invitrogen Corp, Carlsbad, Calif., USA) according to manufacturer's instructions. These methods are described in the next subsection of Common Methods.

Ligation Methods:

For ligations into pSMART vectors:

Gel extracted DNA is blunted using PCRTerminator (Lucigen Corp, Middleton, Wis., USA) according to manufacturer's instructions. Then 500 ng of DNA is added to 2.5 uL 4× CloneSmart vector premix, 1 ul CloneSmart DNA ligase (Lucigen Corp, Middleton, Wis., USA) and distilled water is added for a total volume of 10 ul. The reaction is then allowed to sit at room temperature for 30 minutes and then heat inactivated at 70° C. for 15 minutes and then placed on ice. E. cloni 10G Chemically Competent cells (Lucigen Corp, Middleton, Wis., USA) are thawed for 20 minutes on ice. 40 ul of chemically competent cells are placed into a microcentrifuge tube and 1 ul of heat inactivated CloneSmart Ligation is added to the tube. The whole reaction is stirred briefly with a pipette tip. The ligation and cells are incubated on ice for 30 minutes and then the cells are heat shocked for 45 seconds at 42° C. and then put back onto ice for 2 minutes. 960 ul of room temperature Recovery media (Lucigen Corp, Middleton, Wis., USA) and places into microcentrifuge tubes. Shake tubes at 250 rpm for 1 hour at 37° C. Plate 100 ul of transformed cells on Luria Broth plates (RPI Corp, Mt. Prospect, Ill., USA) plus appropriate antibiotics depending on the pSMART vector used. Incubate plates overnight at 37° C.

For Ligations into StrataClone:

Gel extracted DNA is blunted using PCRTerminator (Lucigen Corp, Middleton, Wis., USA) according to manufacturer's instructions. Then 2 ul of DNA is added to 3 ul StrataClone Blunt Cloning buffer and 1 ul StrataClone Blunt vector mix amp/kan (Stratagene, La Jolla, Calif., USA) for a total of 6 ul. Mix the reaction by gently pipeting up at down and incubate the reaction at room temperature for 30 minutes then place onto ice. Thaw a tube of StrataClone chemically competent cells (Stratagene, La Jolla, Calif., USA) on ice for 20 minutes. Add 1 ul of the cloning reaction to the tube of chemically competent cells and gently mix with a pipette tip and incubate on ice for 20 minutes. Heat shock the transformation at 42° C. for 45 seconds then put on ice for 2 minutes. Add 250 ul pre-warmed Luria Broth (RPI Corp, Mt. Prospect, Ill., USA) and shake at 250 rpm for 37° C. for 2 hour. Plate 100 ul of the transformation mixture onto Luria Broth plates (RPI Corp, Mt. Prospect, Ill., USA) plus appropriate antibiotics. Incubate plates overnight at 37° C.

For Ligations into pCR2.1-TOPO TA:

Add 1 ul TOPO vector, 1 ul Salt Solution (Invitrogen Corp, Carlsbad, Calif., USA) and 3 ul gel extracted DNA into a microcentrifuge tube. Allow the tube to incubate at room temperature for 30 minutes then place the reaction on ice. Thaw one tube of TOP10F'chemically competent cells (Invitrogen Corp, Carlsbad, Calif., USA) per reaction. Add 1 ul of reaction mixture into the thawed TOP10F' cells and mix gently by swirling the cells with a pipette tip and incubate on ice for 20 minutes. Heat shock the transformation at 42° C. for 45 seconds then put on ice for 2 minutes. Add 250 ul pre-warmed SOC media (Invitrogen Corp, Carlsbad, Calif., USA) and shake at 250 rpm for 37° C. for 1 hour. Plate 100 ul of the transformation mixture onto Luria Broth plates (RPI Corp, Mt. Prospect, Ill., USA) plus appropriate antibiotics. Incubate plates overnight at 37° C.

General Transformation and Related Culture Methodologies:

Chemically competent transformation protocols are carried out according to the manufacturer's instructions or according to the literature contained in *Molecular Cloning* (Sambrook and Russell, 2001). Generally, plasmid DNA or ligation products are chilled on ice for 5 to 30 min. in solution with chemically competent cells. Chemically competent cells are a widely used product in the field of biotechnology and are available from multiple vendors, such as those indicated in this Subsection. Following the chilling period cells generally are heat-shocked for 30 seconds at 42° C. without shaking, re-chilled and combined with 250 microliters of rich media, such as S.O.C. Cells are then incubated at 37° C. while shaking at 250 rpm for 1 hour. Finally, the cells are screened for successful transformations by plating on media containing the appropriate antibiotics.

Alternatively, selected cells may be transformed by electroporation methods such as are known to those skilled in the art.

The choice of an *E. coli* host strain for plasmid transformation is determined by considering factors such as plasmid stability, plasmid compatibility, plasmid screening methods and protein expression. Strain backgrounds can be changed by simply purifying plasmid DNA as described herein and transforming the plasmid into a desired or otherwise appropriate *E. coli* host strain such as determined by experimental necessities, such as any commonly used cloning strain (e.g., DH5α, Top 10F', E. cloni 10G, etc.).

Plasmid DNA was prepared using the commercial miniprep kit from Qiagen (Valencia, Calif. USA) according to manufacturer's instructions.

Subsection IIIa. 3-HP Preparation

A 3-HP stock solution was prepared as follows. A vial of β-propriolactone (Sigma-Aldrich, St. Louis, Mo., USA) was opened under a fume hood and the entire bottle contents was transferred to a new container sequentially using a 25-mL glass pipette. The vial was rinsed with 50 mL of HPLC grade water and this rinse was poured into the new container. Two additional rinses were performed and added to the new container. Additional HPLC grade water was added to the new container to reach a ratio of 50 mL water per 5 mL β-propriolactone. The new container was capped tightly and allowed to remain in the fume hood at room temperature for 72 hours. After 72 hours the contents were transferred to centrifuge tubes and centrifuged for 10 minutes at 4,000 rpm. Then the solution was filtered to remove particulates and, as needed, concentrated by use of a rotary evaporator at room temperature. Assay for concentration was conducted, and dilution to make a standard concentration stock solution was made as needed.

Subsection Mb. HPLC, GC/MS and Other Analytical Methods for 3-HP Detection (Analysis of Cultures for 3-HP Production)

For HPLC analysis of 3-HP, the Waters chromatography system (Milford, Mass.) consisted of the following: 600S Controller, 616 Pump, 717 Plus Autosampler, 486 Tunable UV Detector, and an in-line mobile phase Degasser. In addition, an Eppendorf external column heater is used and the data are collected using an SRI (Torrance, Calif.) analog-to-digital converter linked to a standard desk top computer. Data are analyzed using the SRI Peak Simple software. A Coregel 64H ion exclusion column (Transgenomic, Inc., San Jose, Calif.) is employed. The column resin is a sulfonated polystyrene divinyl benzene with a particle size of 10 μm and column dimensions are 300×7.8 mm. The mobile phase consisted of sulfuric acid (Fisher Scientific, Pittsburgh, Pa. USA) diluted with deionized (18 MΩcm) water to a concentration of 0.02 N and vacuum filtered through a 0.2 μm nylon filter. The flow rate of the mobile phase is 0.6 mL/min. The UV detector is operated at a wavelength of 210 nm and the column is heated to 60° C. The same equipment and method as described herein is used for 3-HP analyses for relevant prophetic examples. A representative calibration curve using this HPLC method with a 3-HP standard (TCI America, Portland, Oreg.) is provided in FIG. 13.

Figure 22:
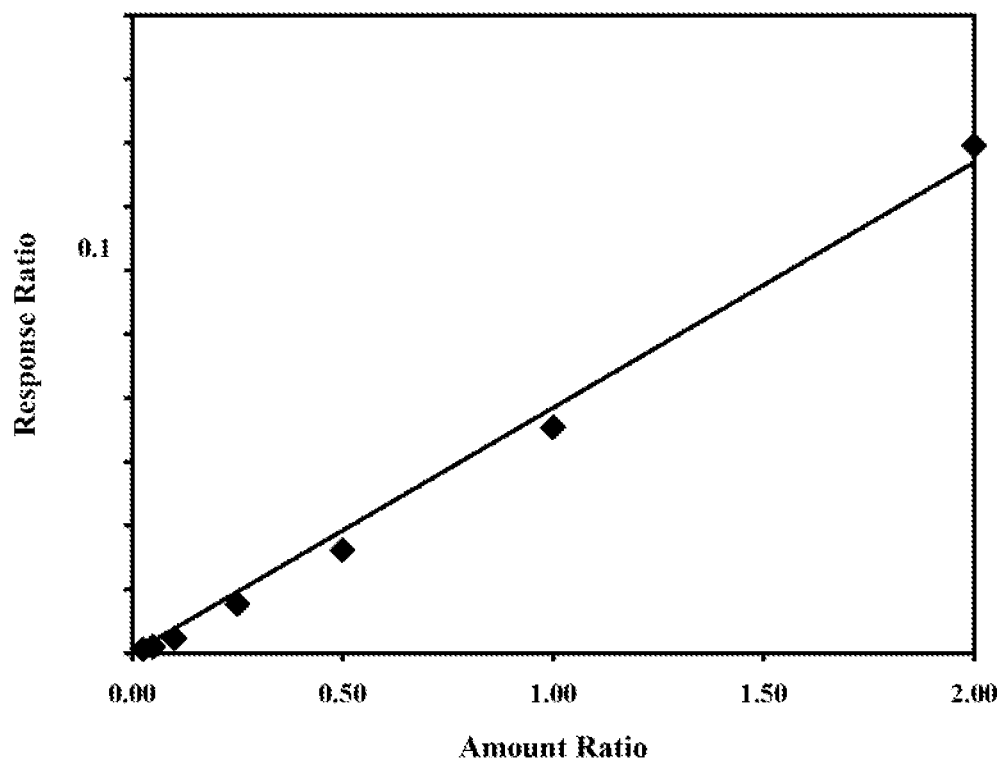
FIG. 22 provides a calibration curve for 3-HP conducted for GC/MS.

The following method is used for GC-MS analysis of 3-HP. Soluble monomeric 3-HP is quantified using GC-MS after a single extraction of the fermentation media with ethyl acetate. Once the 3-HP has been extracted into the ethyl acetate, the active hydrogens on the 3-HP are replaced with trimethylsilyl groups using N,O-Bis-(Trimethylsilyl)trifluoroacetamide to make the compound volatile for GC analysis. A standard curve of known 3-HP concentrations is prepared at the beginning of the run and a known quantity of ketohexanoic acid (1 g/L) is added to both the standards and the samples to act as an internal standard for Quantitation, with tropic acid as an additional internal standard. The 3-HP content of individual samples is then assayed by examining the ratio of the ketohexanoic acid ion (m/z=247) to the 3-HP ion (219) and compared to the standard curve. 3-HP is quantified using a 3HP standard curve at the beginning of the run and the data are analyzed using HP Chemstation. The GC-MS system consists of a Hewlett Packard model 5890 GC and Hewlett Packard model 5972 MS. The column is Supelco SPB-1 (60 m×0.32 mm×0.25 μm film thickness). The capillary coating is a nonpolar methylsilicone. The carrier gas is helium at a flow rate of 1 mL/min. The 3-HP as derivatized is separated from other components in the ethyl acetate extract using either of two similar temperature regimes. In a first temperature gradient regime, the column temperature starts with 40° C. for 1 minute, then is raised at a rate of 10° C./minute to 235° C., and then is raised at a rate of 50° C./minute to 300° C. In a second temperature regime, which was demonstrated to process samples more quickly, the column temperature starts with 70° C. which is held for 1 min, followed by a ramp-up of 10° C./minute to 235° C. which is followed by a ramp-up of 50° C./minute to 300° C. A representative calibration curve is provided in FIG. 22.

A bioassay for detection of 3-HP also was used in various examples. This determination of 3-HP concentration was carried out based on the activity of the $E.\ coli$ 3-HP dehydrogenase encoded by the ydfG gene (the YDFG protein). Reactions of 200-µl were carried out in 96-well microtiter plates, and contained 100 mM Tris-HCl, pH 8.8, 2.5 mM $MgCl_2$, 2.625 mM NADP', 3 µg purified YDFG and 20 µl culture supernatant. Culture supernatants were prepared by centrifugation in a microfuge (14,000 rpm, 5 min) to remove cells. A standard curve of 3-HP (containing from 0.025 to 2 g/l) was used in parallel reactions to quantitate the amount of 3-HP in culture supernatants. Uninoculated medium was used as the reagent blank. Where necessary, the culture supernatant was diluted in medium to obtain a solution with 3-HP concentrations within that of the standard curve.

Figure 23:
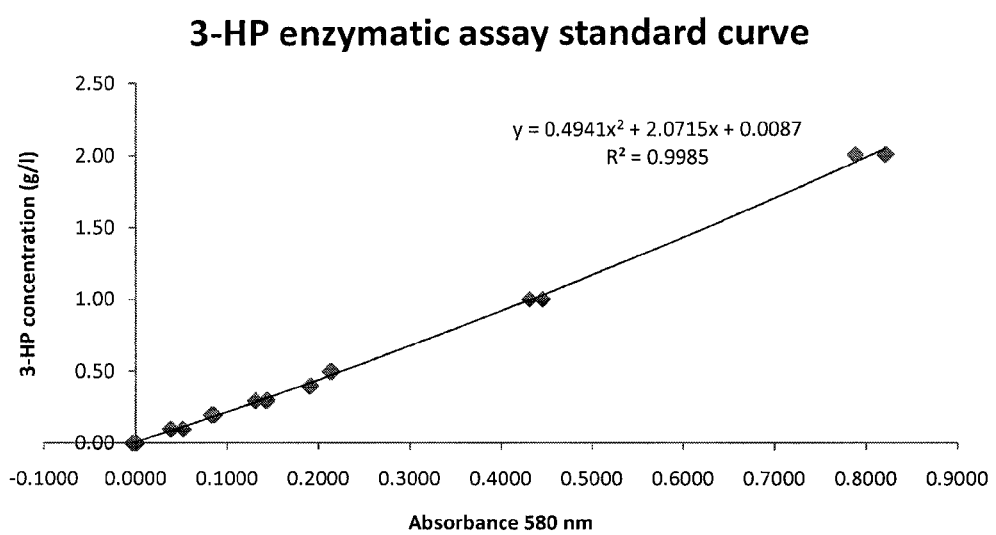
FIG. 23 provides a representative standard curve for the enaymatic assay for 3-HP.
Figure 24:
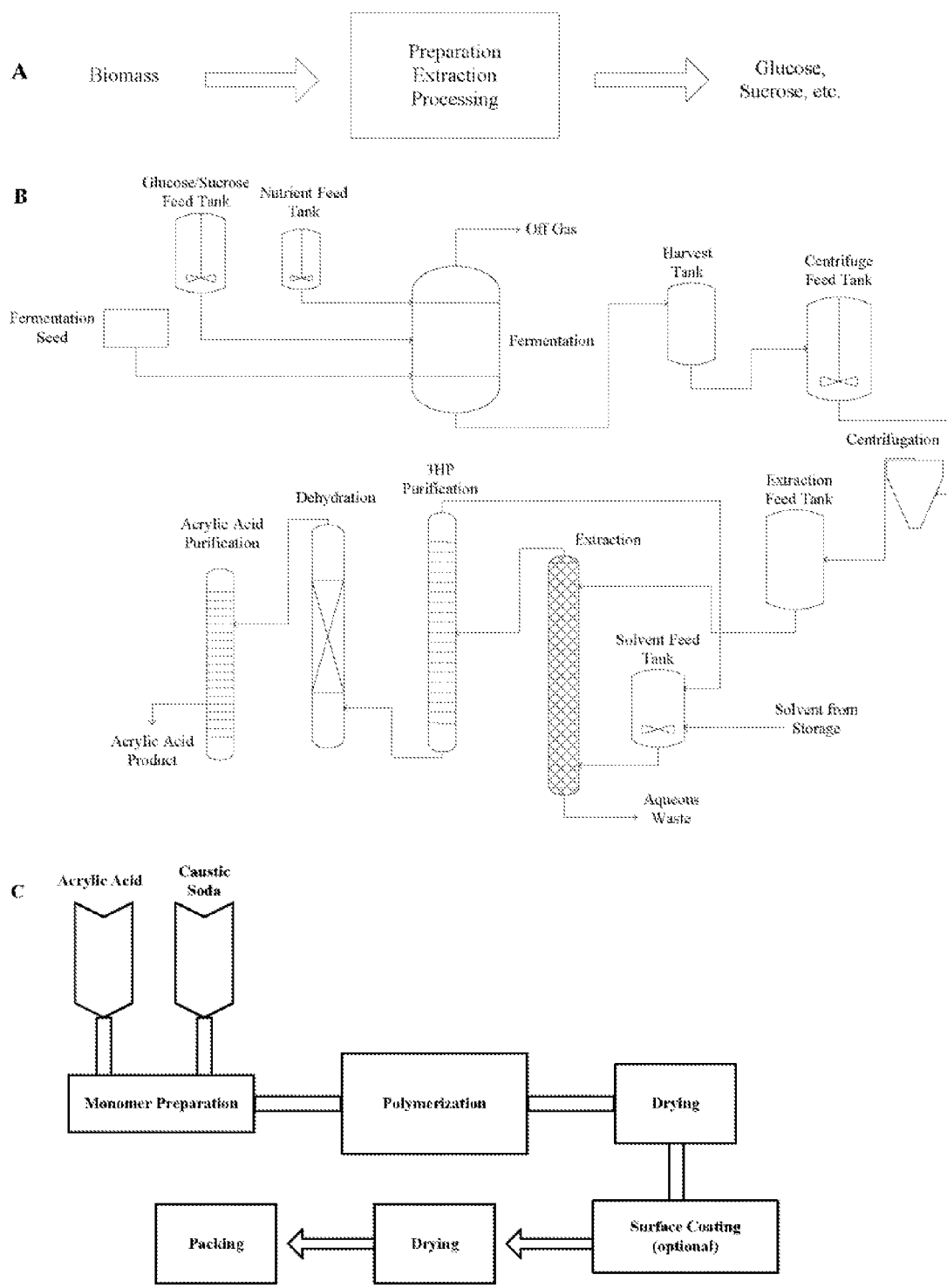
FIGS. 24 A, B, and C and FIGS. 25 A and B show a schematic of the entire process of converting biomass to a finished product such as a diaper.
Figure 25A:
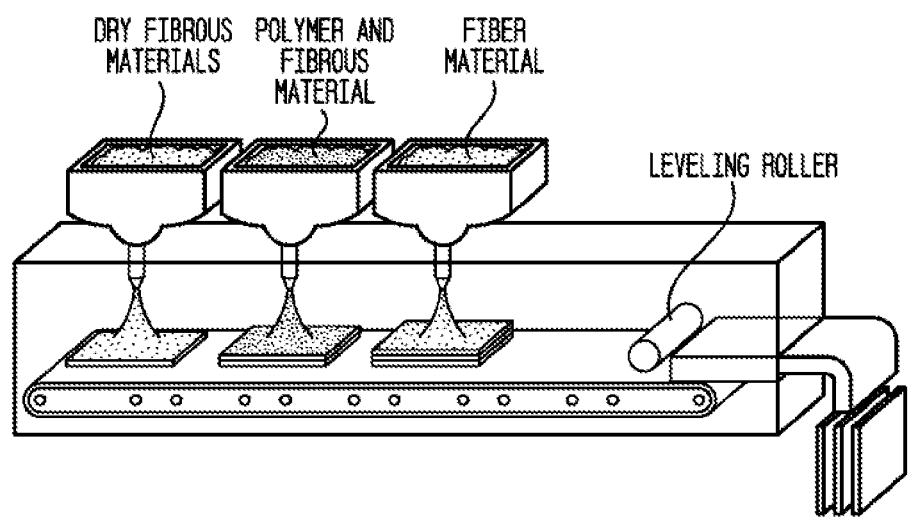
Figure 25B:
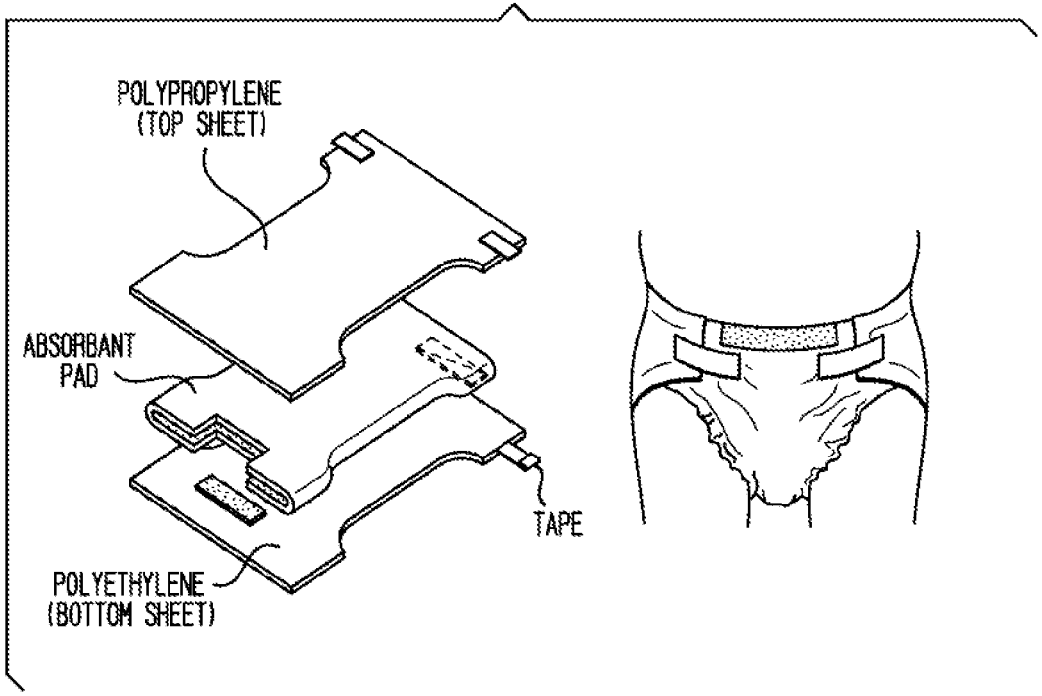

The reactions were incubated at 37° C. for 1 hr, and 20 µl of color developer containing 1.43 mM nitroblue tetrazolium, 0.143 phenazine methosulfate, and 2.4% bovine serum albumin were added to each reaction. Color development was allowed to proceed at 37° C. for an additional hr, and the absorbance at 580 nm was measured. 3-HP concentration in the culture supernatants was quantitated by comparison with the values obtained from the standard curve generated on the same microtiter plate. The results obtained with the enzymatic assay were verified to match those obtained by one of the analytical methods described above. FIG. 23 provides a representative standard curve.

Subsection IV. Minimum Inhibitory Concentration Evaluation (MIC) Protocols

For MIC evaluations, the final results are expressed in chemical agent concentrations determined by analysis of the stock solution by HPLC (i.e., see Subsection Mb).

*E. coli* Aerobic

The minimum inhibitory concentration (MIC) was determined aerobically in a 96 well-plate format. Plates were setup such that each individual well, when brought to a final volume of 100 uL following inoculation, had the following component levels (corresponding to standard M9 media): 47.7 mM $Na_2HPO_4$, 22 mM $KH_2PO_4$, 8.6 mM NaCl, 18.7 mM $NH_4Cl$, 2 mM $MgSO_4$, 0.1 mM $CaCl_2$, and 0.4% glucose. Media supplements were added according to levels reported in the Supplements Table, where specified. Overnight cultures of strains were grown in triplicate in 5 mL LB (with antibiotic where appropriate). A 1% (v/v) inoculum was introduced into a 5 ml culture of M9 minimal media. After the cells reached mid-exponential phase, the culture was diluted to an $OD_{600}$ of about 0.200 (i.e., 0.195-0.205. The cells were further diluted 1:50 and a 10 µL aliquot was used to inoculate each well of a 96 well plate (~$10^4$ cells per well) to total volume of 100 uL. The plate was arranged to measure the growth of variable strains or growth conditions in increasing 3-HP concentrations, 0 to 60 g/L, in 5 g/L increments. Plates were incubated for 24 hours at 37 C. The minimum inhibitory 3-HP concentration and maximum 3-HP concentration corresponding to visible cell growth (OD~0.1) was recorded after 24 hours. For cases when MIC >60 g/L, assessments were performed in plates with extended 3-HP concentrations (0-100 g/L, in 5 g/L increments).

*E. coli* Anaerobic

The minimum inhibitory concentration (MIC) was determined anaerobically in a 96 well-plate format. Plates were setup such that each individual well, when brought to a final volume of 100 uL following inoculation, had the following component levels (corresponding to standard M9 media): 47.7 mM $Na_2HPO_4$, 22 mM $KH_2PO_4$, 8.6 mM NaCl, 18.7 mM $NH_4Cl$, 2 mM $MgSO_4$, 0.1 mM $CaCl_2$, and 0.4% glucose. Media supplements were added according to levels reported in the Supplements Table, where specified. Overnight cultures of strains were grown in triplicate in 5 mL LB (with antibiotic where appropriate). A 1% (v/v) inoculum was introduced into a 5 ml culture of M9 minimal media. After the cells reached mid-exponential phase, the culture was diluted to an $OD_{600}$ of about 0.200 (i.e., 0.195-0.205. The cells were further diluted 1:50 and a 10 mL aliquot was used to inoculate each well of a 96 well plate ($10^4$ cells per well) to total volume of 100 uL. The plate was arranged to measure the growth of variable strains or growth conditions in increasing 3-HP concentrations, 0 to 60 g/L, in 5 g/L increments. Plates were sealed in biobag anaerobic chambers that contained gas generators for anaerobic conditions and incubated for 24 hours at 37 C. The minimum inhibitory 3-HP concentration and maximum 3-HP concentration corresponding to visible cell growth (OD~0.1) was recorded after 24 hours. For cases when MIC >60 g/L, assessments were performed in plates with extended 3-HP concentrations (0-100 g/L, in 5 g/L increments).

*B. subtilis* Aerobic

The minimum inhibitory concentration (MIC) was determined aerobically in a 96 well-plate format. Plates were setup such that each individual well, when brought to a final volume of 100 uL following inoculation, had the following component levels (corresponding to standard M9 media+supplemental glutamate): 47.7 mM $Na_2HPO_4$, 22 mM $KH_2PO_4$, 8.6 mM NaCl, 18.7 mM $NH_4Cl$, 2 mM $MgSO_4$, 0.1 mM $CaCl_2$, 10 mM glutamate and 0.4% glucose. Media supplements were added according to levels reported in the Supplements Table where specified. Overnight cultures of strains were grown in triplicate in 5 mL LB (with antibiotic where appropriate). A 1% (v/v) inoculum was introduced into a 5 ml culture of M9 minimal media+glutamate. After the cells reached mid-exponential phase, the culture was diluted to an $OD_{600}$ of about 0.200 (i.e., 0.195-0.205. The cells were further diluted 1:50 and a 10 µL aliquot was used to inoculate each well of a 96 well plate (~$10^4$ cells per well) to total volume of 100 uL. The plate was arranged to measure the growth of variable strains or growth conditions in increasing 3-HP concentrations, 0 to 60 g/L, in 5 g/L increments. Plates were incubated for 24 hours at 37 C. The minimum inhibitory 3-HP concentration and maximum 3-HP concentration corresponding to visible cell growth (OD~0.1) was recorded after 24 hours. For cases when MIC>60 g/L, assessments were performed in plates with extended 3-HP concentrations (0-100 g/L, in 5 g/L increments).

*C. necator* (*R. eutropha*) Aerobic

The minimum inhibitory concentration (MIC) was determined aerobically in a 96 well-plate format. Plates were setup such that each individual well, when brought to a final volume of 100 uL following inoculation, had the following component levels (corresponding to FGN media): 21.5 mM $K_2HPO_4$, 8.5 mM $KH_2PO_4$, 18 mM $NH_4Cl$, 12 mM NaCl, 7.3 uM $ZnCl_2$, 0.15 uM $MnCl_2$, 4.85 uM $H_3BO_3$, 0.21 uM $CoCl_2$, 0.41 uM CuCl$_2$, 0.50 uM NiCl$_2$, 0.12 uM Na$_2$MoO$_4$, 0.19 uM CrCl$_3$, 0.06 mM CaCl$_2$, 0.5 mM MgSO$_4$, 0.06 mM FeSO$_4$, 0.2% glycerol, 0.2% fructose. Media supplements were added according to levels reported in Supplements Table, where specified. Overnight cultures of strains were grown in triplicate in 5 mL LB (with antibiotic where appropriate). A 1% (v/v) inoculum was introduced into a 5 ml culture of FGN media. After the cells reached mid-exponential phase, the culture was diluted to an OD$_{600}$ of about 0.200 (i.e., 0.195-0.205. The cells were further diluted 1:50 and a 10 µL aliquot was used to inoculate each well of a 96 well plate (~10$^4$ cells per well) to total volume of 100 uL. The plate was arranged to measure the growth of variable strains or growth conditions in increasing 3-HP concentrations, 0 to 60 g/L, in 5 g/L increments. Plates were incubated for 24 hours at 30 C. The minimum inhibitory 3-HP concentration and maximum 3-HP concentration corresponding to visible cell growth (OD~0.1) was recorded after 24 hours. For cases when MIC >60 g/L, assessments were performed in plates with extended 3-HP concentrations (0-100 g/L, in 5 g/L increments).

The embodiments, variations, sequences, and figures described herein should provide an indication of the utility and versatility of the present invention. Other embodiments that do not provide all of the features and advantages set forth herein may also be utilized, without departing from the spirit and scope of the present invention. Such modifications and variations are considered to be within the scope of the invention.

SEQUENCE LISTING (905 sequences)

SEQ ID NO: 1 - DNA, 5642 bp, Artificial Sequence
  Description of Artificial Sequence: Synthetic polynucleotide
tcagaagcgggtatctaccgcagaggcgagtttttcgaccaggcgttcggtatcctcccagcccagacacgggtcggtaatggattgaccgtaagtgagcggctgactgccgacgattttttgcgttccttcgcgcaggaaactttccgccataattccagcaatcgccgtagagccattgcggatttgctgacaaatatcctcacaaacttctaactggcgacggtgctgcttctggcagttaccgtggctgaaatccaccaccagatgttcaggtaaatcaaactcgtgcagcgtatcgcaggctgcggcgatatcatcggcatgataattcggttttttgccgccacgcataataatgtggccatacgggttgccgctggtctgatagatggtcatctgaccatttttgtctggcgagaggaacatatggctggcgcgggctgcgcggatagcatccacagcaatccgcgtattgccatcggtaccatttttaaaacctaccggacaggagagtgccgaagccatttcgcggtggatctgactttcggtagtacgtgcgccaatcgcgccccaactgattaaatcagcaataaactgaccggtcaccatatcgaggaactcggtcgcggttgggacgcccagctcatttacctgtaaaagtaatttgcgcgccagctccagaccgtgatttacccgatagctgccgtttaaatctggatcggagattagtcctttccagccgacaacagttcgtggtttttcaaaataggtgcgcattacgatttccagccgtgactggtactggttgcgcagcgactgcagacgggtggcgtactccattgcagcggtgagatcgtggatcgagcaggggccaataatgaccaacagtcgcttatcttcaccattcagtattttttcaattctgcggcgggagtcggtgacatgggtggcgacgccaggcgttacgggataccgtagcgcgagttcggcgggcgttaccaggctctcaatacgcgcagtacggagttcgtcagttctgttcattacaagtctcagggaattctgtttcctgtgtgaaattgttatccgctcacaattccacacattatacgagccgatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgataagcccggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacagcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttggctgcaggtcgacggatcccc

SEQ ID NO: 2 - DNA, 3082 bp, Artificial Sequence
  Description of Artificial Sequence: Synthetic polynucleotide
gcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagttccaccatgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctgacagccatgcgcaaccatcaaaagacgttcacgatgctgctggtactggtgctgattggtcttaatatgcgaccactgctcacctccgtcgggccactgctaccgcaattgcgccaggcgagcggaatgagagacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacggcgatcgcgtatttcgtctcgctcaggcgcaatcacgaatgaataacggtttggttggtgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcacttgatgctcgatgagtttttctaaatgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgtt

SEQ ID NO: 3 - DNA, 8252 bp, Artificial Sequence
  Description of Artificial Sequence: Synthetic polynucleotide
gaattccgctagcaggagctaaggaagctaaaatgtccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccgggcttatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaaca

SEQ ID NO: 4 - DNA, 8258 bp, Artificial Sequence
  Description of Artificial Sequence: Synthetic polynucleotide
ttctgtttcctgtgtgaaattgttatccgctcacaattccacacattatacgagccgatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgataagcccggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacagcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttctattaaccgaacgcttcgtccaagatttcttgctgctccacggcatgaaccttcgaggaaccgctgctcggcgcagacatcgcgcgacgggagatacgcttgatgcccgccaacttgtccggcagcaactccggcaactccaaaccgaaacgcggccaggcgccctggttcgctggttcctcctggacccaaaagaactctttgacattttcgtaacgatccagggtttcacgcagacgacgacgcggcaacggcgccagttgctccagacgcacaattgccagatcattacggttgtctttcgccttgcgtgccgccaattcataatacaacttaccggaggtcaacagaatacggctaactttattgcggtcgccgataccatcctcgtaggtcggttcctccaggacgctacggaatttaatctcggtaaaatccttaatctccgaaaccgccgccttgtggcgcagcatggatttcggggtaaacacgatcaacggacgttggatgccgtccaacgcgtggcggcgcagcaagtgaaagtaattggacggggtgctcggcatcgcgatcgtcatgctaccctcagcccacagctgcaaaaagcgctcaatgcgcgccgacgtgtggtccgggccctgaccctcgtggccgtgtggcagcaacagaacaacgttggacagctgaccccatttcgcttcgcccgagctgatgaactcgtcaatgatcgactgggcaccattaacaaagtcgccgaattgcgcctcccacagcacaaccgcgtctggattgccaacggtataaccgtactcaaaacccacagccgcgtattccgacaacggcgaatcataaaccaggaacttaccaccggtcgggctgccgtcgctgttagtcgccagcagctgcagcggggtgaactcctcgccggtgtgacggtcgatcagcacagaatgacgctggctaaaggtgccacgacgagagtcttgaccgctcagacggaccagcttgccctcagcaaccaggctgcccagcgccagcaactcaccaaacgcccagtcaatcttaccctcatacgccatctcacgacgcttttccagcaccggctgaacgcgcgggtgtgccgtgaaaccgttaggcagcgccaggaaggcatcaccgatacgtgccagcagggatttgtcaacagcggtcgccaggcccgctgggatcatttggtccgactcgacgctctccgacggttggacgccgtgcttctccagttcgcgcacttcgttgaacacacgctccagttggccctggtaatcgcgcagcgcatcctccgcctctttcatgctgatgtcgccacgaccgatcagagcctcggtgtaggatttacgggcgccacgcttggtgtccacgacgtcatagacatacggattggtcatagatggatcgtcaccctcattatgaccacgacgacgatagcacagcatgtcaataacaacgtcctttttaaagcgttggcggaagtcaactgccaaacgcgcaacccagacacacgcttctggatcgtcgccgttcacgtggaagattggcgcaccgatcatcttcgccacatccgtgcagtactcgctcgaacgagagtattccggagcggtggtgaagccgatttggttgttcacaatgatgtgaatcgtaccacccacacgatagccaggcagatttgccagattcagcgtctccgcaacaacgccttgacccgcgaaggccgcatcaccgtgcagcatcaacggaacgacggagaatgcacgttggccgtcggagtcaatggaaccgtggtccagcaggtcttgcttcgcacgcaccaaaccttccagcactggatcgaccgcttccaaatgggacggatttgccgtcagggaaacctgaatatcgttatcgccaaacatttgcagatacagacccgtcgcacccaggtggtacttgacatcgccggaaccgtgagcctgggacgggttcagattgccttcaaactccgtaaagatttgcgaatacggtttgcccacgatgttcgccaggacattcaagcgaccacggtgcggcatgccaatgaccacttcatccaaaccatgctcggcacattggtcaatcgccgcgtccatcattggaataacagattccgcaccctccaggctaaaacgcttttggcccacatacttggtttgcaggaaggtttcaaacgcctccgctgcgttcagtttcgacaagatgtacttttgttgagcaacggtcggtttgacgtgcttcgtctcgacacgctgctccagccactccttttgttccgggtccagaatgtgcgcgtactcaacaccgatgtgacggcagtacgcgtcgcgcagcaaacccagcacgtcacgcagctttttgtattgagcacccgcgaaaccgtcaaccttaaagacgcggtccaggtcccacagagtcaggccatgcgtcaacacctccaaatccggatgcgaacgaaagcgcgccttatccaagcgcaacgggtcggtgtccgccatcagatggccgcggttgcgataggccgcgatcaggttcatcacacgtgcgttcttgtcaacgatcgagtccggattatcggtgctccaacgcactggcaggtacgggatgctcagctcgcggaagacctcatcccagaagccatcagacaacagcagttcatgaatggtacgcaggaagtcaccgctttccgcaccttgaatgatacggtggtcgtaggtagaagtcagggtaatcagtttgccaatacccagctcagcgatgcgttcctcggacgcgccttggaactccgccggatattccatcgcaccgacaccgatgatagcaccttgacctggcatcaggcgtggcacagagtgcaccgtgccaatcgtgcccggattcgtcagcgaaatcgtaacgccagcgaagtcctcggtggtcagtttaccatcacgagcacgacggacgatgtcctcgtacgcggtaacgaactgcgcgaagcgcatcgtctcgcaacgtttgataccggccaccaccagagagcgcttgccatctttaccttgcaggtcaatagccagacccagattggtgtgcgcaggagtaaccgccgtcggcttaccgtccacctccgtgtagtggcgattcatattcgggaacttcttaaccgcctgaaccagagcataacccagcaaatgggtaaagctgattttaccaccacgcgtgcgtttcaactgattattgatcacgatacgattatcgatcaacaatttcgctggcacagcacgcaccgaggtcgccgtaggcacttccagcgacgcgctcatgttcttcacgacagcagccgccgcaccacgcaggacagcaacttcatcgccttcggctggcggaggcaccgcggtcttggcggccagagccgccacgacaccgttgcccgctgcggccgtgtcggccggtttcggcggcgcttgcggagccgccgctgccgcacgctcagcgaccaaagggctggtcacacgagtcggctcagcagccggttgggaagtcggctccgggctatagtccaccagaaactcatgccagcttgggtcaacggaagacggatcatcacgaaatttacgatacataccaacacgagacgggtcctgagtcaccatggatatatctccttcttaaagaa

SEQ ID NO: 5 - DNA, 1833 bp, Artificial Sequence
  Description of Artificial Sequence: Synthetic polynucleotide
gacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagtttacgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatctcacggatggcatgacagtaagagaattatgcagtgctgccataaccatgagtgataacactgcggccaacttacttctggcaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggatcacttctgcgctcggccctcccggctggctggtttattgctgataaatctggagccggtgagcgtgggtctcgcggtatcattgcagcactggggccagatggtaagccctcccgcatcgtagttatctacacgacggggagtcaggcaactatggatgaacgaaatagacagatcgctgagataggtgcctcactgattaagcattggtaatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgtt

SEQ ID NO: 6 - DNA, 1980 bp, Artificial Sequence
  Description of Artificial Sequence: Synthetic polynucleotide
gacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacggcgatcgcgtatttcgtctcgctcaggcgcaatcacgaatgaataacggtttggttggtgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcacttgatgctcgatgagtttttctaaatgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgtt

SEQ ID NO: 7 - DNA, 2404 bp, Artificial Sequence
  Description of Artificial Sequence: Synthetic polynucleotide
aacgaattcaagcttgatatcattcaggacgagcctcagactccagcgtaactggactgaaaacaaactaaagcgcccttgtggcgctttagttttgttccgcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagtacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaacgcgtggatccccctcaagtcaaaagcctccggtcggaggcttttgactttctgctatggaggtcaggtatgatttaaatggtcagtattgagcgatatctagagaattcgtc

SEQ ID NO: 8 - DNA, 1884 bp, Artificial Sequence
  Description of Artificial Sequence: Synthetic polynucleotide
gccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacagcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttggctgcaggtcgacggatccccgggaa

SEQ ID NO: 9 - DNA, 2350 bp, Artificial Sequence
  Description of Artificial Sequence: Synthetic polynucleotide
cgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgcggaagagccgatgcttgacgcggaagagccgatgc

SEQ ID NO: 10 - DNA, 7929 bp, Artificial Sequence
  Description of Artificial Sequence: Synthetic polynucleotide
aatgacaaatggtccaaactagtactaataaaattaatcattttgaaagcgcaaacaaagttttatacgaaggtaaagattctaaaaatcctttagcttttaaatactataaccctgaagaagtagtaggcggtaaaacgatgaaagatcagctgcgtttttctgttgcttactggcaccagtttacagcagatggtacggatcaattcgagctcggtacccggggatcctctagagtcgacctgcaggcatgcaagctttcgcgagctcgagatctagatatcgatgaattgatccgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcctgttataaaaaaaggatcaattttgaactctctcccaaagttgatcccttaacgatttagaaatccctttgagaatgtttatatacattcaaggtaaccagccaactaatgacaatgattcctgaaaaaagtaataacaaattactatacagataagttgactgatcaacttccataggtaacaacctttgatcaagtaagggtatggataataaaccacctacaattgcaatacctgttccctctgataaaaagctggtaaagttaagcaaactcattccagcaccagcttcctgctgtttcaagctacttgaaacaattgttgatataactgttttggtgaacgaaagcccacctaaaacaaatacgattataattgtcatgaaccatgatgttgtttctaaaagaaaggaagcagttaaaaagctaacagaaagaaatgtaactccgatgtttaacacgtataaaggacctcttctatcaacaagtatcccaccaatgtagccgaaaataatgacactcattgttccagggaaaataattacacttccgatttcggcagtacttagctggtgaacatctttcatcatataaggaaccatagagacaaaccctgctactgttccaaatataattcccccacaaagaactccaatcataaaaggtatatttttccctaatccgggatcaacaaaaggatctgttactttcctgatatgttttacaaatatcaggaatgacagcacgctaacgataagaaaagaaatgctatatgatgttgtaaacaacataaaaaatacaatgcctacagacattagtataattcctttgatatcaaaatgaccttttatccttacttctttctttaataatttcataagaaacggaacagtgataattgttatcataggaatgagtagaagataggaccaatgaatataatgggctatcattccaccaatcgctggaccgactccttctcccatggctactatcgatccaataagaccaaatgctttacccctattttcctttggaatatagcgcgcaactacaaccattacgagtgctggaaatgcagctgcaccagccccttgaataaaacgagccataataagtaaggaaaagaaagaatggccaacaaacccaattaccgacccgaaacaatttattataattccaaataggagtaaccttttgatgcctaattgatcagatagctttccatatacagctgttccaatggaaaaggttaacataaaggctgtgttcacccagtttgtactcgcaggtggtttattaaaatcatttgcaatatcaggtaatgagacgttcaaaaccatttcatttaatacgctaaaaaaagataaaatgcaaagccaaattaaaatttggttgtgtcgtaaattcgattgtgaataggatgtattcacatttcaccctccaataatgagggcagacgtagtttatagggttaatgatacgcttccctcttttaattgaaccctgttacattcattacacttcataattaattcctcctaaacttgattaaaacattttaccacatataaactaagttttaaattcagtatttcatcacttatacaacaatatggcccgtttgttgaactactctttaataaaataatttttccgttcccaattccacattgcaataatagaaaatccatcttcatcggctttttcgtcatcatctgtatgaatcaaatcgccttcttctgtgtcatcaaggtttaattttttatgtatttcttttaacaaaccaccataggagattaaccttttacggtgtaaaccttcctccaaatcagacaaacgtttcaaattcttttcttcatcatcggtcataaaatccgtatcctttacaggatattttgcagtttcgtcaattgccgattgtatatccgatttatatttatttttcggtcgaatcatttgaacttttacatttggatcatagtctaatttcattgcctttttccaaaattgaatccattgtttttgattcacgtagttttctgtattcttaaaataagttggttccacacataccaatacatgcatgtgctgattataagaattatctttattatttattgtcacttccgttgcacgcataaaaccaacaagatttttattaatttttttatattgcatcattcggcgaaatccttgagccatatctgacaaactcttatttaattcttcgccatcataaacatttttaactgttaatgtgagaaacaaccaacgaactgttggcttttgtttaataacttcagcaacaaccttttgtgactgaatgccatgtttcattgctctcctccagttgcacattggacaaagcctggatttacaaaaccacactcgatacaactttctttcgcctgtttcacgattttgtttatactctaatatttcagcacaatcttttactctttcagcctttttaaattcaagaatatgcagaagttcaaagtaatcaacattagcgattttcttttctctccatggtctcacttttccactttttgtcttgtccactaaaacccttgatttttcatctgaataaatgctactattaggacacataatattaaaagaaacccccatctatttagttatttgtttggtcacttataactttaacagatggggtttttctgtgcaaccaattttaagggttttcaatactttaaaacacatacataccaacacttcaacgcacctttcagcaactaaaataaaaatgacgttatttctatatgtatcaagataagaaagaacaagttcaaaaccatcaaaaaaagacaccttttcaggtgctttttttattttataaactcattccctgatctcgacttcgttctttttttacctctcggttatgagttagttcaaattcgttctttttaggttctaaatcgtgtttttcttggaattgtgctgttttatcctttaccttgtctacaaaccccttaaaaacgtttttaaaggcttttaagccgtctgtacgttccttaaggaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatctgacgcgtgtaactgcgaaggtaaaacgggtgattgaaaataaactaacaaatgaagaggaacgaaagagaagtctagaatttgttacgtttatatcggatgaattactgcaaaatgatacggagcctcgcacatttattattcagaactctcttttatcgctagagaaaatccatactctcgcacagaccaaagaggtagaggaatataaagaagtcataactactctgacaagacatgattcataatttgaaaagcaggtaaactaacccaaaaggcaagactctccgtagtttagaaaagagcaggttgctaataacatataaacagccagttgccgttatgataggtgactggctgcatgggatgaaaaggtgagggtggagacagacataacactcttaatagaagagggtaattctttctcttttatagaaaatcaattaattgaaagtagctccttcattcttaagatcaacgtgatataggtttgctaacctttgcgttcacttaactaacttataggggtaacacttaaaaaagaatcaataacgatagaaaccgctcctaaagcaggtgcattttttcctaacgaagaaggcaatagttcacatttattgtctaaatgagaatggactctagaagaaacttcgtttttaatcgtatttaaaacaatgggatgagattcaattatatgatttctcaagataacagcttctatatcaaatgtattaaggatattggttaatccaattccgatataaaagccaaagttttgaagtgcatttaacatttctacatcatttttatttgcgcgttccacaatctcttttcgagaaatattcttttcttctttagagagcgaagccagtaacgctttttcagaagcatataattcccaacagcctcgatttccacagctgcatttgggtccattaaaatctatcgtcatatgacccatttccccagaaaaaccctgaacacctttatacaattcgttgttaataacaagtccagttccaattccgatattaatactgatgtaaacgatgttttcatagttttttgtcataccaaatactttttcaccgtatgctcctgcattagcttcattttcaacaaaaaccggaacattaaactcactctcaattaaaaactgcaaatctttgatattccaatttaagttaggcatgaaaataatttgctgatgacgatctacaaggcctggaacacaaattcctattccgactagaccataaggggactcaggcatatgggttacaaaaccatgaataagtgcaaataaaatctcttttacttcactagcggaagaactagacaagtcagaagtcttctcgagaataatatttccttctaagtcggttagaattccgttaagatagtcgactcctatatcaataccaatcgagtagcctgcattcttattaaaaacaagcattacaggtcttctgccgcctctagattgccctgccccaatttcaaaaataaaatctttttcaagcagtgtatttacttgagaggagacagtagacttgtttaatcctgtaatctcagagagagttgccctggagacaggggagttcttcaaaatttcatctaatattaatttttgattcattttttttactaaagcttgatctgcaatttgaataataaccactcctttgtttatccaccgaactaagttggtgttttttgaagcttgaattagatatttaaaagtatcatatctaatattataactaaattttctaaaaaaaacattgaaataaacatttattttgtatatgatgagataaagttagtttattggataaacaaactaactcaattaagatagttgatggataaacttgttcacttaaatcaaaggggga

SEQ ID NO: 11 - DNA, 7988 bp, Artificial Sequence
  Description of Artificial Sequence: Synthetic polynucleotide
ctcgagggtaactagcctcgccgatcccgcaagaggcccggcagtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcatgcttaagttattggtatgactggttttaagcgcaaaaaaagttgctttttcgtacctattaatgtatcgttttagaaaaccgactgtaaaaagtacagtcggcattatctcatattataaaagccagtcattaggcctatctgacaattcctgaatagagttcataaacaatcctgcatgataaccatcacaaacagaatgatgtacctgtaaagatagcggtaaatatattgaattacctttattaatgaattttcctgctgtaataatgggtagaaggtaattactattattattgatatttaagttaaacccagtaaatgaagtccatggaataatagaaagagaaaaagcattttcaggtataggtgttttgggaaacaatttccccgaaccattatatttctctacatcagaaaggtataaatcataaaactctttgaagtcattctttacaggagtccaaataccagagaatgttttagatacaccatcaaaaattgtataaagtggctctaacttatcccaataacctaactctccgtcgctattgtaaccagttctaaaagctgtatttgagtttatcacccttgtcactaagaaaataaatgcagggtaaaatttatatccttcttgttttatgtttcggtataaaacactaatatcaatttctgtggttatactaaaagtcgtttgttggttcaaataatgattaaatatctcttttctcttccaattgtctaaatcaattttattaaagttcatttgatatgcctcctaaatttttatctaaagtgaatttaggaggcttacttgtctgctttcttcattagaatcaatccttttttaaaagtcaatattactgtaacataaatatatattttaaaaatatcccactttatccaattttcgtttgttgaactaatgggtgctttagttgaagaataaagaccacattaaaaaatgtggtcttttgtgtttttttaaaggatttgagcgtagcgaaaaatccttttctttcttatcttgataataagggtaactattgccgatcgtccattccgacagcatcgccagtcactatggcgtgctgctagcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcaggccttaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttgacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccacttttcccgcgtttgcagaaacgtggctggcctggttcaccacgcgggaaacggtctgataagagacaccggcatactctgcgacatcgtataacgttactggtttcatcaaaatcgtctccctccgtttgaatatttgattgatcgtaaccagatgaagcactctttccactatccctacagtgttatggcttgaacaatcacgaaacaataattggtacgtacgatctttcagccgactcaaacatcaaatcttacaaatgtagtctttgaaagtattacatatgtaagatttaaatgcaaccgttttttcggaaggaaatgatgacctcgtttccaccggaattagcttggtaccagctattgtaacataatcggtacgggggtgaaaaagctaacggaaaagggagcggaaaagaatgatgtaagcgtgaaaaattttttatcttatcacttgaaattggaagggagattctttattataagaattgtggaattgtgagcggataacaattcccaattaaaggaggaaggatctatgcgcggaagccatcaccatcaccatcaccatcacggatcctctagagtcgacgtccccggggcagcccgcctaatgagcgggcttttttcacgtcacgcgtccatggagatctttgtctgcaactgaaaagtttataccttacctggaacaaatggttgaaacatacgaggctaatatcggcttattaggaatagtccctgtactaataaaatcaggtggatcagttgatcagtatattttggacgaagctcggaaagaatttggagatgacttgcttaattccacaattaaattaagggaaagaataaagcgatttgatgttcaaggaatcacggaagaagatactcatgataaagaagctctaaactattcataaccttacatggaattgatcgaagggtggaaggttaatggtacgaaattaggggatctacctagaaagcacaaggcgataggtcaagcttaaagaacccttacatggatcttacagattctgaaagtaaagaaacaacagaggttaaacaaacagaaccaaaaagaaaaaaagcattgttgaaaacaatgaaagttgatgtttcaatccataataagattaaatcgctgcacgaaattctggcagcatccgaagggaattcatattacttagaggatactattgagagagctattgataagatggttgagacattacctgagagccaaaaaactttttatgaatatgaattaaaaaaaagaaccaacaaaggctgagacagactccaaacgagtctgtttttttaaaaaaaatattaggagcattgaatatatattagagaattaagaaagacatgggaataaaaatattttaaatccagtaaaaatatgataagattatttcagaatatgaagaactctgtttgtttttgatgaaaaaacaaacaaaaaaaatccacctaacggaatctcaatttaactaacagcggccaaactgagaagttaaatttgagaaggggaaaaggcggatttatacttgtatttaactatctccattttaacattttattaaaccccatacaagtgaaaatcctcttttacactgttcctttaggtgatcgcggagggacattatgagtgaagtaaacctaaaaggaaatacagatgaattagtgtattatcgacagcaaaccactggaaataaaatcgccaggaagagaatcaaaaaagggaaagaagaagtttattatgttgctgaaacggaagagaagatatggacagaagagcaaataaaaaacttttctttagacaaatttggtacgcatataccttacatagaaggtcattatacaatcttaaataattacttctttgatttttggggctattttttaggtgctgaaggaattgcgctctatgctcacctaactcgttatgcatacggcagcaaagacttttgctttcctagtctacaaacaatcgctaaaaaaatggacaagactcctgttacagttagaggctacttgaaactgcttgaaaggtacggttttatttggaaggtaaacgtccgtaataaaaccaaggataacacagaggaatccccgatttttaagattagacgtaaggttcctttgctttcagaagaacttttaaatggaaaccctaatattgaaattccagatgacgaggaagcacatgtaaagaaggctttaaaaaaggaaaaagagggtcttccaaaggttttgaaaaaagagcacgatgaatttgttaaaaaaatgatggatgagtcagaaacaattaatattccagaggccttacaatatgacacaatgtatgaagatatactcagtaaaggagaaattcgaaaagaaatcaaaaaacaaatacctaatcctacaacatcttttgagagtatatcaatgacaactgaagaggaaaaagtcgacagtactttaaaaagcgaaatgcaaaatcgtgtctctaagccttcttttgatacctggtttaaaaacactaagatcaaaattgaaaataaaaattgtttattacttgtaccgagtgaatttgcatttgaatggattaagaaaagatatttagaaacaattaaaacagtccttgaagaagctggatatgttttcgaaaaaatcgaactaagaaaagtgcaataaactgctgaagtatttcagcagttttttttatttagaaatagtgaaaaaaatataatcagggaggtatcaatatttaatgagtactgatttaaatttatttagactggaattaataattaacacgtagactaattaaaatttaatgagggataaagaggatacaaaaatattaatttcaatccctattaaattttaacaagggggggattaaaatttaattagaggtttatccacaagaaaagaccctaataaaatttttactagggttataacactgattaatttcttaatgggggagggattaaaatttaatgacaaagaaaacaatcttttaagaaaagcttttaaaagataataataaaaagagctttgcgattaagcaaaactctttactttttcattgacattatcaaattcatcgatttcaaattgttgttgtatcataaagttaattctgttttgcacaaccttttcaggaatataaaacacatctgaggcttgttttataaactcagggtcgctaaagtcaatgtaacgtagcatatgatatggtatagcttccacccaagttagcctttctgcttcttctgaatgtttttcatatacttccatgggtatctctaaatgattttcctcatgtagcaaggtatgagcaaaaagtttatggaattgatagttcctctctttttcttcaacttttttatctaaaacaaacactttaacatctgagtcaatgtaagcataagatgtttttccagtcataatttcaatcccaaatcttttagacagaaattctggacgtaaatcttttggtgaaagaatttttttatgtagcaatatatccgatacagcaccttctaaaagcgttggtgaatagggcattttacctatctcctctcattttgtggaataaaaatagtcatattcgtccatctacctatcctattatcgaacagttgaactttttaatcaaggatcagtcctttttttcattattcttaaactgtgctcttaactttaacaactcgatttgtttttccagat

SEQ ID NO: 12 - DNA, 15537 bp, Artificial Sequence
  Description of Artificial Sequence: Synthetic polynucleotide
ttagtcgcactgcaaggggtgttatgagccatattcaggtataaatgggctcgcgataatgttcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagcttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtcccgcagccgaacgaccgagcgcagcggcgagagtagggaactgccaggcatcttttagcgctgacagctgtctcttatacacatctataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgagctcttaacctgccaggaagaaacggaaggccggattgttcgtctcgtcgtggcagtcataacccagctcattcagacgcgtctcaaaatccggctcgtgatcacccagttcgaacgccgccaggacacggccgtaatcggtgccatggctgcgatagtgaaacagggaaatgttccagtaggtacccagggtgttcaggaaacgcagcagcgcgcctggagactccgggaactcgaagctgtacaggcgctcctgcagcgggtggctcggacggccacccaccatgtaacgaacgtgcagctttgccatttcgtcatcgctcagatcgacaacagaataaccgccgtcattcagcatttgcaggatttctttacgttcttccagaccacggctcagacgcacgcccacgaagatgcatgcgtttttcgcgtctgcgaagcggtaattgaactcggtcacgctacgaccgcccagcaattggcaaaacttcagaaaagagcctttttcttccgggatagtaaccgccagcagtgcttcacgttgctcacccagctcgcaacgttcgctgacgtagcgcagaccgtggaaattcacattcgcaccgctcagaatgtgcgccagacgttcgccacggatgttgtgcagggcaatgtatttcttcatgcccgccagagccagggcaccgctcggctcagcgactgcgcggacatcttcgaacagatccttcattgcggcgcagatcgcatcgctatcgaccgtaatgatatcatccaagtattcctgacacaggcgaaacgtctcatcgccaatgcgtttaactgcaacgccttccgcaaacagaccaacacgcggcagatcgaccgggtggcctgcgtccagtgccgctttcagacatgcgctatcctccgcctcaactgcgatgaccttaatctgcggcatcaattgcttgatcagaacagcaacgcctgccgccaggccaccaccgccaaccggcacaaagacgcggtccagatgcgcgtcctgttgcagcagttccaaggccaacgtgccctgacccgcgatcaccatcggatgatcaaacggcgggacccaggtaaagccttgctgttggctcagttcgatcgctttcgctttagcttcatcgaagtttgcaccgtgcaacagaacttcgccaccaaaaccacgcactgcgtcaaccttaatgtcagcggttgccgtcggcatgacgatcagtgctttaacacccagacgcgcggacgagaaggcgacaccctgcgcgtggttacccgcgctggcggtaatgacgccgtgggctttctgctcttcggtcaaacctgccatcattgcatacgcaccacgcagtttgaagctgtggaccggctggcgatcctcgcgcttcaccaggatcacattatccagacggctgctcagcttttccatcttctgcagcggggtcacctgggctgcctcatacaccggcgcacgcagaaccgcacgcaggtattccgcgccttccggcgcaccgctcagcggctggctgtctgccatggaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatatgaattcgccggcttatgcggtcaccgaggccaaacgctcctgaacgatcgcgataaagtcgcgcaacgccggtttcattttaattctccacgcttataagcgaataaaggaagatggccgccccgcagggcagcaggtctgtgaaacagtatagagattcatcggcacaaaggctttgctttttgtcatttattcaaaccagtactgatatcttaaatgcccgcaccctgcgagaagtgttcttcaccaaacacgccagtgctcaaatagcgatcaccgcggtcacaaatgattgcgacgaccactgcatccggattcgccttggcgacgcgcagagcacccgcgactgcaccaccgctgctaacaccacagaagatgccttcgcggactgccagctcgcgcatggtgttttctgcatcgcgctgatggatgtccaacacctcatccaccaggctggcgttaaagatgcccggcagatactccgtaggccaacggcggatgcccggaatgctgctgccttcttccggctgcagacccacaatggtaaccggcttggattgttcgcgcatgaagcggctgacgccggtaatcgtgcccgtcgtgcccatgctcgaaacgaaatgggtaatacgaccaccggtctgttgccaaatctccggaccggtcgtggtatagtgcgcgtacggattgtcaggattgttgaactggtccaacagcttaccctcgccacgattcgccatttccagtgccaggtcacgcgcaccttccataccctgttctttggtaaccaagatcagttccgcaccataagcacgcatcgccgcacgacgttcttgagacatgttatctggcatcagcagtttcatacggtaacccttcagcgcggcaatcattgccagtgcgataccggtgttaccgctggtcgcttcaatcagaacgtcacccggcttgatctcaccacgtttttcagcctcgacaatcatgctcagagccgcacgatccttaacgctgcccgctgggttattgccctccagcttcagccacacttcgctaccgttgtccggacccatgcgttgcagcttaaccagcggggtattgccaatcgtctgctccagcgtggacatggtgaatcctctcgttgagtgtgcgccactgatttgggtgccatcgacaatggcactgtgcggatcgtggttaaaatctacagagaccaacggcaattccgtatagtcaactataccatgaaatgcaccttgtgctgctttttgcagcaacaggttgacttcgtttaaacgatatcggatccggtaccttatgccaactgacgcagcatacggcgcagcggttccgccgcaccccacagcagctgatcaccaaccgtaaacgcgctcaagaactctgggcccatgttcagcttacgcagacgaccgaccggggtggtcagcgtgcccgtaacggcagccggggtcagctcacgcatggtgatttcacgatcgttaggaaccaccttcgcccacggattgtgggcagccagcagctcttcaaccgtcggaatggacacatctttcttcagcttgatggtgaatgcttgggagtggcaacgcagagcgccaacgcgcacgcacagaccgtcaaccggaataacagaagaggtgttcaggattttgttagtttctgcttgacccttccactcttcacggctttgaccattgtccagctgcttatcgatccacggaatcaggctacccgccagtggcacaccgaagttgtcaaccggcagttcaccggaacgcgtcagggtggtaaccttgcgttcaatgtccaggatcgcggaggacggggtcgccaactcgtcggcaacatgaccatacaggtgacccatctgcgtcaacaattcacgcatgtggcgtgcaccgccaccgctggccgcttggtaggtggccacggaaacccagtcaaccaggtcgttcgcaaacaaaccacccaggctcatcagcatcaagctaacggtacagttgccgccgacaaaggtacggatgccattgttcaggccgtcggtgataacgtcctggttcaccgggtccaaaatgatgatggcgtcatccttcatacgcaggctgctagccgcatcgatccagtaaccttgccagccagattcacgcagcttcgggtagatttcgttcgtatagtcaccaccttggcaagtcacaatgatgtccagagctttcagggcctccaggtcaaaggcgtcctgcagggtacccgtggtaccgccgaagctcggcgcagcctgacccagttggctggtggagaaaaacactgggcgaattgcatcgaagtcacgctcttccaccatacgctgcatcaggacgctgccgaccataccgcgccagccgataaagccgacattcttcatgatcgtttcgcctgtggtatgaaatttcacacgcattatatacaaaaaaagcgattcagaccccgttggcaagccgcgtggttaactcttaacagatctttacacgcccagcttccagctcagggtacgcagcagatccgcgaaaacgccagccgcggtgacatcgttaccggcaccataaccgcgcagcaccagcggcagcggctgatagtaatggctatagaacgccagcgcattctcgccattcttgaccttaaacaaagggtcgttgccatcaacctctgcaatcttaacacggcaaacaccatcctcatcgatgttaccaacataacgcaagactttaccttcgtcgcgggctttcgcaacacgggctgcgaacagatcgtccagctgagacagatttgccataaacgccgcgacatcaccctctgcattgaactccgcaggcagaaccggctcgatctcaatatccgccagttccagttcacggcccgtctcacgcgccagaatcagcagcttacgggcgacatccataccggacaggtcgtcgcgagggtctggttcggtatagcccatttcgcgagccagggtagtcgcttcgctaaagctcatgccttcatccaacttgccgaagatatagctcaggctaccagacaggataccgctgaatttcatcagttcgtcacccgcgttcagcaggttttgcaggttttcgatgaccggcagaccagcgcccacattggtgtcatacaggaacttacgacggcttttctcggctgcataacgcagctgatggtagtagtccatgctgctagtattcgcctttttgttcggcgtaacaacgtgaaagccctcacgcaggaagtcagcgtattggtccgcgaccgcctggctgctggtacaatcgacgatcaccggattcagcaggtggtactctttcaccagacgaatcagacgacccaggttaaacggctcttttgcttgcgccagttcttcctgccaattctccagattcagaccgtgcacattggtcagcaatgctttgctattcgcgacgccgcaaacacgcaggtcgatgtgcttattcttcagccaggattgttggcgtttcagctgttccagcagcgcaccgcccacaccaccgacgccgataacaaaaacttcaatgacttggtccgtgttaaacagcatctggtgagtcacacgaacacccgtggtcgcgtcgtcgttattcaccacaacagaaatgctgcgctcgctgctaccttgtgcaatggccacaatgttgatattcgcgcgtgccagagcagcgaaaaactttgcgctaataccacgcagggtacgcataccatcaccgaccacgctgataatcgccaaacgttcggtaacggccagcggctccagcaggccctctttcagttccagatagaactcttcttgcatcgcacgttctgcacgaacgcaatcggattgcggaacacaaaagctaatgctgtactcgctagagctttgagtaatcaggaccacgctaatgcgagcgcggctcattgctgcaaaaacacgggctgccataccaaccatacctttcatacccggaccgctaacgctgaacatagccatgttgttcagattagagatgcctttaaccggcaattcgtcctcatcacgggacgcaccgatcagggtaccaggtgcctgaggattgccggtattcttgatcaaacacgggatctggaattgagcaattggggtgatcgtgcgcgggtgcaggactttggcaccgaagtaagacagctccatcgcttcctggtacgacatgcttttcagcaagcgcgcgtccgggacctggcgagggtcgcacgtatacacaccatccacatcggtccagatttcgcagcaatcggcacgcaggcaagcagccagaacagcggcgctgtaatcggaaccgttgcgacccaggacaaccagttcgcctttctcgttgcctgccgtaaaacccgccatcagaaccatgtggtcagctgggatgcggctggccgcaatacgacgggtgctctcggcaatatcgacggtgctctccagataatggccgacagccagcagtttctccacagggtcaatgacggtaacgttgtggccgcgtgcctccaacacaccggccatgatcgcgatgctcatcttctcgccacgacagatcagggctgcgttaatgctatccgggcactggcccagcaggctaatgccatgcagaacatgcttaatctgtgcaaattcctgatcgacgaacgttttcagttgcgccaacggaaagcccggttgggctgccgccaggccggtcaacagctcggcaaagatgcgctccgcatcgctgatgttcggcaatgcgtcctgaccgctaatggtcttttcaatcatcgccaccagatggttagtaatctttgccggagcagacaggacggttgcaacctgaccctgacgcgcgttgctctccagaatgtccgcaacgcgcaagaaacgctctgcatttgccacggacgtaccgccaaacttcagcacacgcatggaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatatgacgtctcatgattagactgctggcatgttacgaccgtagtaaatctcacgcatctctttccacagcgcagccgtaatctcttgacgctcgctatccgtcaaatcctccggcttggtatggaacatatagtgtttcagatcgaactctttcagcagcatcttagtgtgaaagatattctcctggtagacattaacgtccaccatatcgtacagagctttcatgtcgtcggacatgaaattctggatgctgttgatctcatggtcgatgaagtgcttcataccattgatgtcacgggtaaagccgcgcacgcggtaatcaatcgtaacgatatcgctctccagttgatggatcaggtaattcaatgctttcagcggcgagataacgccgcaggtgctcacctcaatgtctgcgcgaaaggtacacagaccaccctccgggtggctttccgggtaggtgtgaacgcagatgtggcttttgtccagatgggcaacaaccgtctccggcaacggacctgggtgttcggttttgtcaatcaacttaggatcgacaggctcttcggaaaccaggatcgtcacggaggcaccctgcggttcgtaatcttggcgcgcaatgttcagaatgttcgcgccgatgatggaacaagtctcgctcaaaatctccgtcaggcggtttgcgttgtacagttcatcgatataggcaatgtagccgtcacgttcttccgccgtctttgcatagcaaatgtcatagatacaaaacgacaagctcttagtcagattgttgaaaccgtgcaatttcagcttcttcattttcttatcttctcctcatgagtcgacttagctcggctgagaagccagcgcgtcttgcaggtactgcggcagcgcaaacgcagcggtatggatcgccgggttgtaatagcggcacttcagaccgctcgccaggaaacgtgcttgaatgatttcggtgctcaagtgacgcagcgcgtcattgtcggtggcccacgcaaaggtcataatgccaccatagtacgtcgggatcgctgcctggtagaagccaacgtcgctaaagtaatgagacagtttgcggtggctatcgatcgcctcttcttgctgcaggaaacacacaccattctgcgcgacaaagataccgccagggttcagacaacgtttacaaccctcgtaaaaggcggaggtgaacagggactcaccagggccaatcggatcagtgcaatcggagataatcacatcaaacgtttggctcgtttgattgacgaagttcacaccatcgtcgatgaccagtttgaaacgcgggtcatcatacgagcctgcattatggttcggcaggtattggcgacagaaggacacgacacccgcatcaatctcgaccatggtaatgctctccacgttcttgtgacgggtaacttcgcgcagcatcgcgccatcaccaccgccgataatcaacacatgtttagcatgaccgtgtgccagcagcggcacatgggtcatcatctcgtgatagataaactcatcgcgctcagtggtttggaccacgccgtccagcgccataacgcgaccgaaggccgcgttttcaaagatgatcaggtcttggtggtcggttttctcgtggtacagaacattatcaaccgcgaaatactgaccaaattggtcatgcagcgtctcgtgccactgtttcttctcggccattttagcttccttagctcctgtctagtgtcgacactagtttacaatttctcgcccttcagcaaggtagattgtgcatcacgcggcttaatgacataacaccagacctgtttgcggccgtcatgttcttcaatgtagacaccctgcagctccggcgcaaaacccggcaacagattgataccctcttccagggccgagaagtaacgcagcaccgcaccaccccaaatctcacccggcacgacacacagcacaccaggtgggtacggcagggcaccttcggccgcaatgcggccctccgcatccggcaaacgcaccaactcgacttcaccgcgcagatacgcgtaattggcttcctgcgggttcatgctgacacgcggaaaatgttctttacgaaacatctctttctgcagttgtttgacattgtgacgcgcgtacaaatcatgcatctcttggcacagttgacgcagggtgtagcccgcataacgctcttcgtgctgtttgtaaatgctcggcagcacctcggccagcggggcatcggactccagcaatttctcaaagcggaccagcagtgcaaccagttgctgcaatttggccatatcctctgccggggtcaacaaaaacaggatgctattcagatcacacttctccggcacaacgccattttcacgcagaaagttggccaggatggtggccgggacgccgaacgcctcatactcgccgttacgcgcgtcaatgcctggggtagtcagcagcagtttgcacggatcgacaaagtattgattctctgcgtagccctcgaaagagtgccagtgctcacccggaacgaattggaaaaagcgcaggtccactgcaatttgcgcggtttcatagctctgccatggtttaccgtccaccagctccgggacaaacgggcggatatgttggcagttatccaggatcagtttacgggcgttaatgccgttgacaacgcaatccatccacatgttgcgaccgctcacaccctcgtgcatcttggcattgatgttcagcgcagcgaacagcgggtagaacgggctagtgctcgcatgcatcataaaggcgttattcatacgtttatgcggcacgtagcgttgctggcctttgatgtggctatcctttttgtgaatttggctggtctggctgaaacccgcttgttgcttatgcacagactgggtaaccaaaatgcccggatcgttctcgttcagatccagcaacagcgggctgcagtctgccatcataggaatgaactgctcataaccgacccaggcgctgtcgaacaggatatagtcacacaggtgaccgatcttatccacgacctggcgtgcattgtaaatcgtaccatcatacgtgcccagctgaatcacagccagacggaacggacgggcttctttcgcacgctgcggtgccacctctgcgatcagttcacgcaaatagctttcttcgaagcaatgcgcgtcgatgccaccaatgaagccgtacggattacgcgcggtttccaggtaaaccggggtcgcaccggcttgcaacagcgcaccgtgatggttgcttttgtgattgttacgatcgaacagaaccagatcacctggggtcagcagggcattcagaaccactttgttggagctagaggtaccgttcaggacgaagtaggtcttgtcggcgttgaaaaccttcgctgcgtgttgttgtgcaatacatggtgcgccctcgtggatcagcaggtcacccatagcaacgtccgcattacacagatccgcacgaaacagcgcctcaccaaagtattccacaaactgattgccagccggatgacgacggaagaactcaccaccctggtggcccggacagtcgaacgcgctgttaccctggttgacatagtccaccagtgcacgaaagaacggcggacgcagttgcgtctcatagtggctcgcagccgtttccagctggcgaccgtagaactcacgacggctctcgcaattctcaaaaacgccgctaatacgcggcaggtactcggctggaacacgctcctgattttcggtcgcaatgaacaccggaataccgtaaccggtcgcgtcaatctcatccagcttgccgcacgtaacatcattcaggctcaggacgattgcggcgacatcgatgttacgcgactcattgatatagatgcactcgcgttgcgtcgtaaagcaatccgggcagctgtcgctcaccgcaatcttcaatttgctcattttagcttccttagctcctgactagtataaagttaaagagcagtgccgcttcgctttttccacacattatacgagccggatgattaattgtcaacagctcatttcacccgggattacccgcgacgcgcattaaccacggcgtgccttaaccgcattagccagctgacgcaacagggcgtcggtatcctcccagccgatgcacgcatcggtgatgctcttgccgtatgccagcggttcaccgctttccaggctttgattaccttcgaccagatggctctccaccatgacaccgataatcgccttctcaccgcctgcaatttgttggcaaacgtcggcgcacacatccatttgtttcttgaattgtttgctgctattggcatggctaaagtcgatcatcacctgcgctggcaaacctgctttgttcagaccctctttcacttcagcaacatgctttgcgctgtagttcggctctttgccaccgcgcaggatgatgtgacagtcgccattgccgctcgtattcacgatggcggaatgaccccacttggtcacggacagaaagcagtgcggagcacctgcggcgttgattgcgtcgattgcaactttgatggtaccgtcggtaccattcttgaaaccgaccgggcagctcaaaccgcttgccagctcacgatggacctgagactccgtggtgcgagcgccaattgcaccccagctcatcagatccgccaagtattgcggggtaatcatgtccaggaactcgcctgccgctggcagaccgctgtcgttaatgtccagcagcagtttacgcgcgatacgcagaccatcattgatctgaaagctgttgtccatatgtgggtcgttaatcagacctttccagcccaccgtcgtacgcggtttctcgaaatacacacgcatcacaatctccagctcatctttcagctcttcgcgcagtgccagcaaacgggtcgcatattctttcgctgcaaccgggtcgtgaatggaacacgggccaatgaccaccagcagacgatcgtcattgcccttcagaatcttgtgaatagctttacgggcatgagccacggtgttcgcggcattttccgtcgccggaaacttttccagcagagccactggcggcaacagctctttgatctctttgatacgcaggtcatcattctgatagttcattttaattctccacgcttataagcgaataaaggaagatggccgccccgcagggcagcaggtctgtgaaacagtatagagattcatcggcacaaaggctttgctttttgtcatttattcaaaccggcgccatcagaacggttgtcggattaaaacggcttggtcggcaggtacttaccatccagggtgataaccgcacgttcgccaccttccgggtcggcaaccttcttaacgtccagtttgaagttaatcgcagagatgatgccgtcaccaaacttttcgtggaccagagccttcagagtcgtaccataaacctgcagcatctcatagaagcggtacatcgtcggatcggtcgggatgcggtcatcaatacagccacgcagcgggatcatctgcaacagcagaatgctgtcctcgtccaggtccagcttcgcacccaccagacgcgctgcatctgctggcagtgcctgttgacccaacagtgctgccgtcacgaaggcctccgccaaacccgtaccgtccgcaatctctgcaaagctcaggtctttctttgctttgctcagcagaatcgcgtccgccaaatccaggcgaatgttacggttaatctggctctgaatcatggtggaactcctgatggtttaaaaataagggacgtgttacgctgcggtcggttgacgcaacggaatggcacaaacgcgtggattggcagccagcgggacaaactgacgggtcgcgccgtcgaatgcggcaatgctgccgctctcaatgtcatacacccaaccgtgcagcgcaatgcgaccttcttccaacgccaaacggacgctcggatgcgtttgcagattggccaactgtgcgataacattctcgcgcaccatagccgcagccttagatggcaggtcagagtgcggacgcgcttcgttcaccacacgcgcgctgtccgcgtaacgcaaccagtggctaaccgcaggcatgtggtccatacactggcaagaggcaatagccgtcatcgcaccacaattgctgtggccgcagataacaatatcgctcacgcgcagcgccgcaaccgcgtactcaacgctcgccgagacaccacccggctcaggaccgtaggacggcacgatgttaccggcattacgaatcacgaacaggtcaccaggttcacgttgggtcaccagctccgggaccagacgggagtcgctgcagctaatgaacagcgtacgcgggctttgctgggtagccaactgtttgaacagggcctcacgtttcggaaacgcttcgcgttgaaacttcaagaagccatcaatgatttctttcattttagcttccttagctcctgtgcgcaataaagttaaagagcagtgccgcttcgctttttccacacattatacgagccggatgattaattgtcaacagctcatttcacacgtgagatgtgtataagagacagctgtcagcgctccccgacgagcttcatgccg

SEQ ID NO: 13 - DNA, 1375 bp, Artificial Sequence
  Description of Artificial Sequence: Synthetic polynucleotide
ataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgaggggattacccgcgacgcgcattaaccacggcgtgccttaaccgcattagccagctgacgcaacagggcgtcggtatcctcccagccgatgcacgcatcggtgatgctcttgccgtatgccagcggttcaccgctttccaggctttgattaccttcgaccagatggctctccaccatgacaccgataatcgccttctcaccgcctgcaatttgttggcaaacgtcggcgcacacatccatttgtttcttgaattgtttgctgctattggcatggctaaagtcgatcatcacctgcgctggcaaacctgctttgttcagaccctctttcacttcagcaacatgctttgcgctgtagttcggctctttgccaccgcgcaggatgatgtgacagtcgccattgccgctcgtattcacgatggcggaatgaccccacttggtcacggacagaaagcagtgcggagcacctgcggcgttgattgcgtcgattgcaactttgatggtaccgtcggtaccattcttgaaaccgaccgggcagctcaaaccgcttgccagctcacgatggacctgagactccgtggtgcgagcgccaattgcaccccagctcatcagatccgccaagtattgcggggtaatcatgtccaggaactcgcctgccgctggcagaccgctgtcgttaatgtccagcagcagtttacgcgcgatacgcagaccatcattgatctgaaagctgttgtccatatgtgggtcgttaatcagacctttccagcccaccgtcgtacgcggtttctcgaaatacacacgcatcacaatctccagctcatctttcagctcttcgcgcagtgccagcaaacgggtcgcatattctttcgctgcaaccgggtcgtgaatggaacacgggccaatgaccaccagcagacgatcgtcattgcccttcagaatcttgtgaatagctttacgggcatgagccacggtgttcgcggcattttccgtcgccggaaacttttccagcagagccactggcggcaacagctctttgatctctttgatacgcaggtcatcattctgatagttcattttaattctccacgcttataagcgaataaaggaagatggccgccccgcagggcagcaggtctgtgaaacagtatagagattcatcggcacaaaggctttgctttttgtcatttattcaaaccggcgtga

SEQ ID NO: 14 - DNA, 4222 bp, Artificial Sequence
  Description of Artificial Sequence: Synthetic polynucleotide
ataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgaggtctcatgattagactgctggcatgttacgaccgtagtaaatctcacgcatctctttccacagcgcagccgtaatctcttgacgctcgctatccgtcaaatcctccggcttggtatggaacatatagtgtttcagatcgaactctttcagcagcatcttagtgtgaaagatattctcctggtagacattaacgtccaccatatcgtacagagctttcatgtcgtcggacatgaaattctggatgctgttgatctcatggtcgatgaagtgcttcataccattgatgtcacgggtaaagccgcgcacgcggtaatcaatcgtaacgatatcgctctccagttgatggatcaggtaattcaatgctttcagcggcgagataacgccgcaggtgctcacctcaatgtctgcgcgaaaggtacacagaccaccctccgggtggctttccgggtaggtgtgaacgcagatgtggcttttgtccagatgggcaacaaccgtctccggcaacggacctgggtgttcggttttgtcaatcaacttaggatcgacaggctcttcggaaaccaggatcgtcacggaggcaccctgcggttcgtaatcttggcgcgcaatgttcagaatgttcgcgccgatgatggaacaagtctcgctcaaaatctccgtcaggcggtttgcgttgtacagttcatcgatataggcaatgtagccgtcacgttcttccgccgtctttgcatagcaaatgtcatagatacaaaacgacaagctcttagtcagattgttgaaaccgtgcaatttcagcttcttcattttcttatcttctcctcatgagtcgacttagctcggctgagaagccagcgcgtcttgcaggtactgcggcagcgcaaacgcagcggtatggatcgccgggttgtaatagcggcacttcagaccgctcgccaggaaacgtgcttgaatgatttcggtgctcaagtgacgcagcgcgtcattgtcggtggcccacgcaaaggtcataatgccaccatagtacgtcgggatcgctgcctggtagaagccaacgtcgctaaagtaatgagacagtttgcggtggctatcgatcgcctcttcttgctgcaggaaacacacaccattctgcgcgacaaagataccgccagggttcagacaacgtttacaaccctcgtaaaaggcggaggtgaacagggactcaccagggccaatcggatcagtgcaatcggagataatcacatcaaacgtttggctcgtttgattgacgaagttcacaccatcgtcgatgaccagtttgaaacgcgggtcatcatacgagcctgcattatggttcggcaggtattggcgacagaaggacacgacacccgcatcaatctcgaccatggtaatgctctccacgttcttgtgacgggtaacttcgcgcagcatcgcgccatcaccaccgccgataatcaacacatgtttagcatgaccgtgtgccagcagcggcacatgggtcatcatctcgtgatagataaactcatcgcgctcagtggtttggaccacgccgtccagcgccataacgcgaccgaaggccgcgttttcaaagatgatcaggtcttggtggtcggttttctcgtggtacagaacattatcaaccgcgaaatactgaccaaattggtcatgcagcgtctcgtgccactgtttcttctcggccattttagcttccttagctcctgtctagtgtcgacactagtttacaatttctcgcccttcagcaaggtagattgtgcatcacgcggcttaatgacataacaccagacctgtttgcggccgtcatgttcttcaatgtagacaccctgcagctccggcgcaaaacccggcaacagattgataccctcttccagggccgagaagtaacgcagcaccgcaccaccccaaatctcacccggcacgacacacagcacaccaggtgggtacggcagggcaccttcggccgcaatgcggccctccgcatccggcaaacgcaccaactcgacttcaccgcgcagatacgcgtaattggcttcctgcgggttcatgctgacacgcggaaaatgttctttacgaaacatctctttctgcagttgtttgacattgtgacgcgcgtacaaatcatgcatctcttggcacagttgacgcagggtgtagcccgcataacgctcttcgtgctgtttgtaaatgctcggcagcacctcggccagcggggcatcggactccagcaatttctcaaagcggaccagcagtgcaaccagttgctgcaatttggccatatcctctgccggggtcaacaaaaacaggatgctattcagatcacacttctccggcacaacgccattttcacgcagaaagttggccaggatggtggccgggacgccgaacgcctcatactcgccgttacgcgcgtcaatgcctggggtagtcagcagcagtttgcacggatcgacaaagtattgattctctgcgtagccctcgaaagagtgccagtgctcacccggaacgaattggaaaaagcgcaggtccactgcaatttgcgcggtttcatagctctgccatggtttaccgtccaccagctccgggacaaacgggcggatatgttggcagttatccaggatcagtttacgggcgttaatgccgttgacaacgcaatccatccacatgttgcgaccgctcacaccctcgtgcatcttggcattgatgttcagcgcagcgaacagcgggtagaacgggctagtgctcgcatgcatcataaaggcgttattcatacgtttatgcggcacgtagcgttgctggcctttgatgtggctatcctttttgtgaatttggctggtctggctgaaacccgcttgttgcttatgcacagactgggtaaccaaaatgcccggatcgttctcgttcagatccagcaacagcgggctgcagtctgccatcataggaatgaactgctcataaccgacccaggcgctgtcgaacaggatatagtcacacaggtgaccgatcttatccacgacctggcgtgcattgtaaatcgtaccatcatacgtgcccagctgaatcacagccagacggaacggacgggcttctttcgcacgctgcggtgccacctctgcgatcagttcacgcaaatagctttcttcgaagcaatgcgcgtcgatgccaccaatgaagccgtacggattacgcgcggtttccaggtaaaccggggtcgcaccggcttgcaacagcgcaccgtgatggttgcttttgtgattgttacgatcgaacagaaccagatcacctggggtcagcagggcattcagaaccactttgttggagctagaggtaccgttcaggacgaagtaggtcttgtcggcgttgaaaaccttcgctgcgtgttgttgtgcaatacatggtgcgccctcgtggatcagcaggtcacccatagcaacgtccgcattacacagatccgcacgaaacagcgcctcaccaaagtattccacaaactgattgccagccggatgacgacggaagaactcaccaccctggtggcccggacagtcgaacgcgctgttaccctggttgacatagtccaccagtgcacgaaagaacggcggacgcagttgcgtctcatagtggctcgcagccgtttccagctggcgaccgtagaactcacgacggctctcgcaattctcaaaaacgccgctaatacgcggcaggtactcggctggaacacgctcctgattttcggtcgcaatgaacaccggaataccgtaaccggtcgcgtcaatctcatccagcttgccgcacgtaacatcattcaggctcaggacgattgcggcgacatcgatgttacgcgactcattgatatagatgcactcgcgttgcgtcgtaaagcaatccgggcagctgtcgctcaccgcaatcttcaatttgctcattttagcttccttagctcctgactagtataaagttaaagagcagtgccgcttcgctttttccacacattatacgagccggatgattaattgtcaacagctcatttcacccgtgag

SEQ ID NO: 15 - DNA, 2815 bp, Artificial Sequence
  Description of Artificial Sequence: Synthetic polynucleotide
ataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgagaactcttaacagatctttacacgcccagcttccagctcagggtacgcagcagatccgcgaaaacgccagccgcggtgacatcgttaccggcaccataaccgcgcagcaccagcggcagcggctgatagtaatggctatagaacgccagcgcattctcgccattcttgaccttaaacaaagggtcgttgccatcaacctctgcaatcttaacacggcaaacaccatcctcatcgatgttaccaacataacgcaagactttaccttcgtcgcgggctttcgcaacacgggctgcgaacagatcgtccagctgagacagatttgccataaacgccgcgacatcaccctctgcattgaactccgcaggcagaaccggctcgatctcaatatccgccagttccagttcacggcccgtctcacgcgccagaatcagcagcttacgggcgacatccataccggacaggtcgtcgcgagggtctggttcggtatagcccatttcgcgagccagggtagtcgcttcgctaaagctcatgccttcatccaacttgccgaagatatagctcaggctaccagacaggataccgctgaatttcatcagttcgtcacccgcgttcagcaggttttgcaggttttcgatgaccggcagaccagcgcccacattggtgtcatacaggaacttacgacggcttttctcggctgcataacgcagctgatggtagtagtccatgctgctagtattcgcctttttgttcggcgtaacaacgtgaaagccctcacgcaggaagtcagcgtattggtccgcgaccgcctggctgctggtacaatcgacgatcaccggattcagcaggtggtactctttcaccagacgaatcagacgacccaggttaaacggctcttttgcttgcgccagttcttcctgccaattctccagattcagaccgtgcacattggtcagcaatgctttgctattcgcgacgccgcaaacacgcaggtcgatgtgcttattcttcagccaggattgttggcgtttcagctgttccagcagcgcaccgcccacaccaccgacgccgataacaaaaacttcaatgacttggtccgtgttaaacagcatctggtgagtcacacgaacacccgtggtcgcgtcgtcgttattcaccacaacagaaatgctgcgctcgctgctaccttgtgcaatggccacaatgttgatattcgcgcgtgccagagcagcgaaaaactttgcgctaataccacgcagggtacgcataccatcaccgaccacgctgataatcgccaaacgttcggtaacggccagcggctccagcaggccctctttcagttccagatagaactcttcttgcatcgcacgttctgcacgaacgcaatcggattgcggaacacaaaagctaatgctgtactcgctagagctttgagtaatcaggaccacgctaatgcgagcgcggctcattgctgcaaaaacacgggctgccataccaaccatacctttcatacccggaccgctaacgctgaacatagccatgttgttcagattagagatgcctttaaccggcaattcgtcctcatcacgggacgcaccgatcagggtaccaggtgcctgaggattgccggtattcttgatcaaacacgggatctggaattgagcaattggggtgatcgtgcgcgggtgcaggactttggcaccgaagtaagacagctccatcgcttcctggtacgacatgcttttcagcaagcgcgcgtccgggacctggcgagggtcgcacgtatacacaccatccacatcggtccagatttcgcagcaatcggcacgcaggcaagcagccagaacagcggcgctgtaatcggaaccgttgcgacccaggacaaccagttcgcctttctcgttgcctgccgtaaaacccgccatcagaaccatgtggtcagctgggatgcggctggccgcaatacgacgggtgctctcggcaatatcgacggtgctctccagataatggccgacagccagcagtttctccacagggtcaatgacggtaacgttgtggccgcgtgcctccaacacaccggccatgatcgcgatgctcatcttctcgccacgacagatcagggctgcgttaatgctatccgggcactggcccagcaggctaatgccatgcagaacatgcttaatctgtgcaaattcctgatcgacgaacgttttcagttgcgccaacggaaagcccggttgggctgccgccaggccggtcaacagctcggcaaagatgcgctccgcatcgctgatgttcggcaatgcgtcctgaccgctaatggtcttttcaatcatcgccaccagatggttagtaatctttgccggagcagacaggacggttgcaacctgaccctgacgcgcgttgctctccagaatgtccgcaacgcgcaagaaacgctctgcatttgccacggacgtaccgccaaacttcagcacacgcatggaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatatgtga

SEQ ID NO: 16 - DNA, 1386 bp, Artificial Sequence
  Description of Artificial Sequence: Synthetic polynucleotide
ataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgagaaacgatatcggatccggtaccttatgccaactgacgcagcatacggcgcagcggttccgccgcaccccacagcagctgatcaccaaccgtaaacgcgctcaagaactctgggcccatgttcagcttacgcagacgaccgaccggggtggtcagcgtgcccgtaacggcagccggggtcagctcacgcatggtgatttcacgatcgttaggaaccaccttcgcccacggattgtgggcagccagcagctcttcaaccgtcggaatggacacatctttcttcagcttgatggtgaatgcttgggagtggcaacgcagagcgccaacgcgcacgcacagaccgtcaaccggaataacagaagaggtgttcaggattttgttagtttctgcttgacccttccactcttcacggctttgaccattgtccagctgcttatcgatccacggaatcaggctacccgccagtggcacaccgaagttgtcaaccggcagttcaccggaacgcgtcagggtggtaaccttgcgttcaatgtccaggatcgcggaggacggggtcgccaactcgtcggcaacatgaccatacaggtgacccatctgcgtcaacaattcacgcatgtggcgtgcaccgccaccgctggccgcttggtaggtggccacggaaacccagtcaaccaggtcgttcgcaaacaaaccacccaggctcatcagcatcaagctaacggtacagttgccgccgacaaaggtacggatgccattgttcaggccgtcggtgataacgtcctggttcaccgggtccaaaatgatgatggcgtcatccttcatacgcaggctgctagccgcatcgatccagtaaccttgccagccagattcacgcagcttcgggtagatttcgttcgtatagtcaccaccttggcaagtcacaatgatgtccagagctttcagggcctccaggtcaaaggcgtcctgcagggtacccgtggtaccgccgaagctcggcgcagcctgacccagttggctggtggagaaaaacactgggcgaattgcatcgaagtcacgctcttccaccatacgctgcatcaggacgctgccgaccataccgcgccagccgataaagccgacattcttcatgatcgtttcgcctgtggtatgaaatttcacacgcattatatacaaaaaaagcgattcagaccccgttggcaagccgcgtggttgtga

SEQ ID NO: 17 - DNA, 1264 bp, Artificial Sequence
  Description of Artificial Sequence: Synthetic polynucleotide
ataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgagactgatatcttaaatgcccgcaccctgcgagaagtgttcttcaccaaacacgccagtgctcaaatagcgatcaccgcggtcacaaatgattgcgacgaccactgcatccggattcgccttggcgacgcgcagagcacccgcgactgcaccaccgctgctaacaccacagaagatgccttcgcggactgccagctcgcgcatggtgttttctgcatcgcgctgatggatgtccaacacctcatccaccaggctggcgttaaagatgcccggcagatactccgtaggccaacggcggatgcccggaatgctgctgccttcttccggctgcagacccacaatggtaaccggcttggattgttcgcgcatgaagcggctgacgccggtaatcgtgcccgtcgtgcccatgctcgaaacgaaatgggtaatacgaccaccggtctgttgccaaatctccggaccggtcgtggtatagtgcgcgtacggattgtcaggattgttgaactggtccaacagcttaccctcgccacgattcgccatttccagtgccaggtcacgcgcaccttccataccctgttctttggtaaccaagatcagttccgcaccataagcacgcatcgccgcacgacgttcttgagacatgttatctggcatcagcagtttcatacggtaacccttcagcgcggcaatcattgccagtgcgataccggtgttaccgctggtcgcttcaatcagaacgtcacccggcttgatctcaccacgtttttcagcctcgacaatcatgctcagagccgcacgatccttaacgctgcccgctgggttattgccctccagcttcagccacacttcgctaccgttgtccggacccatgcgttgcagcttaaccagcggggtattgccaatcgtctgctccagcgtggacatggtgaatcctctcgttgagtgtgcgccactgatttgggtgccatcgacaatggcactgtgcggatcgtggttaaaatctacagagaccaacggcaattccgtatagtcaactataccatgaaatgcaccttgtgctgctttttgcagcaacaggttgacttcgtttgtga

SEQ ID NO: 18 - DNA, 1893 bp, Artificial Sequence
  Description of Artificial Sequence: Synthetic polynucleotide
ataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaatgagctcttaacctgccaggaagaaacggaaggccggattgttcgtctcgtcgtggcagtcataacccagctcattcagacgcgtctcaaaatccggctcgtgatcacccagttcgaacgccgccaggacacggccgtaatcggtgccatggctgcgatagtgaaacagggaaatgttccagtaggtacccagggtgttcaggaaacgcagcagcgcgcctggagactccgggaactcgaagctgtacaggcgctcctgcagcgggtggctcggacggccacccaccatgtaacgaacgtgcagctttgccatttcgtcatcgctcagatcgacaacagaataaccgccgtcattcagcatttgcaggatttctttacgttcttccagaccacggctcagacgcacgcccacgaagatgcatgcgtttttcgcgtctgcgaagcggtaattgaactcggtcacgctacgaccgcccagcaattggcaaaacttcagaaaagagcctttttcttccgggatagtaaccgccagcagtgcttcacgttgctcacccagctcgcaacgttcgctgacgtagcgcagaccgtggaaattcacattcgcaccgctcagaatgtgcgccagacgttcgccacggatgttgtgcagggcaatgtatttcttcatgcccgccagagccagggcaccgctcggctcagcgactgcgcggacatcttcgaacagatccttcattgcggcgcagatcgcatcgctatcgaccgtaatgatatcatccaagtattcctgacacaggcgaaacgtctcatcgccaatgcgtttaactgcaacgccttccgcaaacagaccaacacgcggcagatcgaccgggtggcctgcgtccagtgccgctttcagacatgcgctatcctccgcctcaactgcgatgaccttaatctgcggcatcaattgcttgatcagaacagcaacgcctgccgccaggccaccaccgccaaccggcacaaagacgcggtccagatgcgcgtcctgttgcagcagttccaaggccaacgtgccctgacccgcgatcaccatcggatgatcaaacggcgggacccaggtaaagccttgctgttggctcagttcgatcgctttcgctttagcttcatcgaagtttgcaccgtgcaacagaacttcgccaccaaaaccacgcactgcgtcaaccttaatgtcagcggttgccgtcggcatgacgatcagtgctttaacacccagacgcgcggacgagaaggcgacaccctgcgcgtggttacccgcgctggcggtaatgacgccgtgggctttctgctcttcggtcaaacctgccatcattgcatacgcaccacgcagtttgaagctgtggaccggctggcgatcctcgcgcttcaccaggatcacattatccagacggctgctcagcttttccatcttctgcagcggggtcacctgggctgcctcatacaccggcgcacgcagaaccgcacgcaggtattccgcgccttccggcgcaccgctcagcggctggctgtctgccatggaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatatgaattcgccgtga

SEQ ID NO: 19 - DNA, 2463 bp, Artificial Sequence
  Description of Artificial Sequence: Synthetic polynucleotide
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 20 - DNA, 2123 bp, Artificial Sequence
  Description of Artificial Sequence: Synthetic polynucleotide
ggtcaggtatgatttaaatggtcagtattgagcgatatctagagaattcgtcctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagttccaccatgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctgacagccatgcgcaaccatcaaaagacgttcacgatgctgctggtactggtgctgattggtcttaatatgcgaccactgctcacctccgtcgggccactgctaccgcaattgcgccaggcgagcggaatgagctttagcgtggctgccctgttgaccgctctgccggtggttaccatgggcgggctggcgctggccggaagctggcttcatcagcatgtcagcgaacgtcgcagtgtcgccatcagtctgttgctgattgccgtcggtgcattgatgcgtgagctttacccgcaaagtgcgctgctgcttagcagcgcactgcttggtggggtggggatcggcatcattcaggcggtgatgccttcggtgattaaacggcggtttcagcagcgcacgccactggtgatggggctgtggtccgcggctctgatgggcggcggtgggcttggtgccgccataacgccctggttagttcaacatagcgaaacctggtatcaaacactcgcctggtgggcgctgcctgccgttgttgcgctctttgcctggtggtggcaaagcgcccgcgaggtcgcctcttcccacaagacaacaaccactccggttcgcgtggtattcactccccgcgcgtggacgctgggtgtttacttcggtctgattaacggcggttacgccagcctgattgcctggttacccgctttctatattgagattggtgccagcgcgcagtacagcggttccttactggcattgatgacgcttgggcaagccgcaggagctttgctgatgcctgctatggctcgccatcaggatcggcgcaaactgttaatgctggcgctggtgttacaactggtggggttctgcggctttatctggctgccgatgcaattgccggtattgtgggcgatggtgtgtgggttaggtctgggcggcgcgtttccgctctgtttgctgctggcgctcgatcactctgtgcaaccggctattgctggcaagaacgaattcaagcttgatatcattcaggacgagcctcagactccagcgtaactggactg

SEQ ID NO: 21 - DNA, 20 bp, Artificial Sequence
  Description of Artificial Sequence: Synthetic primer
gtccctttcagcatcgacat

SEQ ID NO: 22 - DNA, 20 bp, Artificial Sequence
  Description of Artificial Sequence: Synthetic primer
tggtgacgtaccagaaatca

SEQ ID NO: 23 - DNA, 1212 bp, Artificial Sequence
  Description of Artificial Sequence: Synthetic polynucleotide
gtccctttcagcatcgacattcccgtattccgactcgccgttcccacactcattcattaaaagaatatggcgacataccttattggcgacgttcatggttgttacgatgaactgatcgcattgctgcataaagtagaatttacccctgggaaagataccctctggctgacgggcgatctggtcgcgcgcgggccgggttcgctggatgttctgcgctatgtgaaatccttaggcgacagcgtacgtctggtgctgggcaatcacgatctgcatctgctggcggtatttgccgggatcagccgcaataaaccgaaagatcgcctgacaccgctgctggaagcgccggatgccgacgagctgcttaactggctgcggcgccagcctctgctgcaaatcgacgaagagaaaaagctggtgatggcccacgcagggatcacgccgcagtgggatctgcagaccgccaaagagtgcgcacgcgatgtagaagcggtgctatcgagtgactcctatcccttctttcttgatgccatgtacggcgatatgccaaataactggtcaccggaattgcgggggctgggaagactgcgttttatcaccaacgcttttacccgtatgcgtttttgcttcccgaacggtcaactggatatgtacagcaaagaatcgccggaagaggcccctgccccactgaaaccgtggtttgcgattcctggccctgtcgctgaagaatacagcatcgcctttggtcactgggcatcgctggagggcaaaggtacgccggaaggtatatacgcgctggataccggctgctgctggggtggtacattaacctgcctgcgctgggaagataaacagtattttgtccagccgtcgaaccggcataaggatttgggcgaagcggcggcgtcttaaacacagcctgatataggaaggccggataagacgcgaccggcgtcgcatccggcgctagccgtaaattctatacaaaattaccgccgctccagaatctcaaagcaatagctgtgagagttctgcgcatcagcatcgtggaattcgctgaataccgattcccagtcatccggctcgtaatccgggaaatgggtgtcgccttccacttctgcgtcgatatgcgtcagatacagtttttgcgcttttggcaagaactgttcataaacgcgaccgccgccaatcaccatgatttctggtacgtcacca

SEQ ID NO: 24 - DNA, 25 bp, Artificial Sequence
  Description of Artificial Sequence: Synthetic primer
cagctaactgtttgtttttgtttca

SEQ ID NO: 25 - DNA, 21 bp, Artificial Sequence
  Description of Artificial Sequence: Synthetic primer
ggcgctagccgtaaattctat

SEQ ID NO: 26 - DNA, 672 bp, Artificial Sequence
  Description of Artificial Sequence: Synthetic polynucleotide
cagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaattttgtatagaatttacggctagcgcc

SEQ ID NO: 27 - DNA, 20 bp, Artificial Sequence
  Description of Artificial Sequence: Synthetic primer
tcactgaacaggcagcattc

SEQ ID NO: 28 - DNA, 19 bp, Artificial Sequence
  Description of Artificial Sequence: Synthetic primer
gacgattttgcagcgtttg

SEQ ID NO: 29 - DNA, 1630 bp, Artificial Sequence
  Description of Artificial Sequence: Synthetic polynucleotide
tcactgaacaggcagcattcaccagttcgccttcaaagtgaattgtaccgccatctacaacggcagcataactacccgtagcggcgaatagtgcggcagccagcgcagacgaaataaatcttaatttcatatatattccttcaatctcatttatcgactccacatccgtatataaccgattactttatttaagacactgatagtagtaaattcctttttatcctctaagaatgtcttaattgaaaatatgcactctattctaaaaaatagagagccccgttagatgaatacttccgcgcaaaatatattcaacacaaatatagacctgaagcggtaaattaccaggctgaaaattctttttatattgtcaggtatttcttaaattatcttaatccttagacaaggaaataaatcagttccagatttacaacgccatcatggacgaaaaatgaagctttcagtctcagcgacggtgcgcctcaccttcgcaagaggtcgcttcacgcgataaatctgaaacgaaacctgacagcgcgccccgcttctgacaaaataggcgcatccccttcgatctacgtaacagatggaatcctctctctgatggcagcaaagattattgacggtaaaacgattgcgcagcaggtgcgctctgaagttgctcaaaaagttcaggcgcgtattgcagccggactgcgggcaccaggactggccgttgtgctggtgggtagtaaccctgcatcgcaaatttatgtcgcaagcaaacgcaaggcttgtgaagaagtcgggttcgtctcccgctcttatgacctcccggaaaccaccagcgaagcggagctgctggagcttatcgatacgctgaatgccgacaacaccatcgatggcattctggttcaactgccgttaccggcgggtattgataacgtcaaagtgctggaacgtattcatccggacaaagacgtggacggtttccatccttacaacgtcggtcgtctgtgccagcgcgcgccgcgtctgcgtccctgcaccccgcgcggtatcgtcacgctgcttgagcgttacaacattgataccttcggcctcaacgccgtggtgattggcgcatcgaatatcgttggccgcccgatgagcatggaactgctgctggcaggttgcaccactacagtgactcaccgcttcactaaaaatctgcgtcatcacgtagaaaatgccgatctattgatcgttgccgttggcaagccaggctttattcccggtgactggatcaaagaaggcgcaattgtgattgatgtcggcatcaaccgtctggaaaatggcaaagttgtgggcgacgtcgtgtttgaagacgcggctaaacgcgcctcatacattacgcctgttcccggcggcgttggcccgatgacggttgccacgctgattgaaaacacgctacaggcgtgcgttgaatatcatgatccacaggatgagtaacatggcgacattttctttaggtaaacatccgcacgttgagctgtgcgacttgctgaaactggaaggctggagcgaaagcggcgcgcaggcgaaaatcgcgattgccgaaggccaggtgaaagtcgacggtgcggttgaaacgcgcaaacgctgcaaaatcgtc

SEQ ID NO: 30 - DNA, 20 bp, Artificial Sequence
  Description of Artificial Sequence: Synthetic primer
tcgggcaattatttcgtcat

SEQ ID NO: 31 - DNA, 20 bp, Artificial Sequence
  Description of Artificial Sequence: Synthetic primer
aacaaaccagatgcgatggt

SEQ ID NO: 32 - DNA, 1132 bp, Artificial Sequence
  Description of Artificial Sequence: Synthetic polynucleotide
tcgggcaattatttcgtcatgacggaaaagaagatgaacgacgcgagttagtggtgtttatcacgccacgactggtttccagtgagtaaacagccgtaaaagcggtaatgtttttacgctgaacgtgtttcatctatttgacgcgcgcaggtatttagcatacaaggagtaccgatttgagagttggtgctcttcgctgcctgcgttccatgatgatgatttatcattcaggcggcattttgctgtcttttttacgctaatcttacccggtgatttatcgccagagcggtggtagcaaggcagcgcgcttgcagcgaccagatatgcagagggatgggtgatttattcagttgccaaacccgctggagtattgagataattttcagtctgactctcgcaatatcttatgaggtttcagttcatgtcctgcggcgctctctgagcgaagcgggtttatcattaacgaatagtcttagtagtaccgaaaaaatggcagagaaacgcaatatctttctggttgggcctatgggtgccggaaaaagcactattgggcgccagttagctcaacaactcaatatggaattttacgattccgatcaagagattgagaaacgaaccggagctgatgtgggctgggttttcgatttagaaggcgaagaaggcttccgcgatcgcgaagaaaaggtcatcaatgagttgaccgagaaacagggtattgtgctggctactggcggcggctctgtgaaatcccgtgaaacgcgtaaccgtctttccgctcgtggcgttgtcgtttatcttgaaacgaccatcgaaaagcaacttgcacgcacgcagcgtgataaaaaacgcccgttgctgcacgttgaaacaccgccgcgtgaagttctggaagcgttggccaatgaacgcaatccgctgtatgaagagattgccgacgtgaccattcgtactgatgatcaaagcgctaaagtggttgcaaaccagattattcacatgctggaaagcaactaattctggctttatatacactcgtctgcgggtacagtaattaaggtggatgtcgcgttatggagaggattgtcgttactctcggggaacgtagttacccaattaccatcgcatctggtttgtt

SEQ ID NO: 33 - DNA, 20 bp, Artificial Sequence
  Description of Artificial Sequence: Synthetic primer
cagaatgcgaagacgaacaa

SEQ ID NO: 34 - DNA, 20 bp, Artificial Sequence
  Description of Artificial Sequence: Synthetic primer
gcattagctgggaaatgacc

SEQ ID NO: 35 - DNA, 2491 bp, Artificial Sequence
  Description of Artificial Sequence: Synthetic polynucleotide
cagaatgcgaagacgaacaataaggcctcccaaatcggggggccttttttattgataacaaaaaggcaacactatgacatcggaaaacccgttactggcgctgcgagagaaaatcagcgcgctggatgaaaaattattagcgttactggcagaacggcgcgaactggccgtcgaggtgggaaaagccaaactgctctcgcatcgcccggtacgtgatattgatcgtgaacgcgatttgctggaaagattaattacgctcggtaaagcgcaccatctggacgcccattacattactcgcctgttccagctcatcattgaagattccgtattaactcagcaggctttgctccaacaacatctcaataaaattaatccgcactcagcacgcatcgcttttctcggccccaaaggttcttattcccatcttgcggcgcgccagtatgctgcccgtcactttgagcaattcattgaaagtggctgcgccaaatttgccgatatttttaatcaggtggaaaccggccaggccgactatgccgtcgtaccgattgaaaataccagctccggtgccataaacgacgtttacgatctgctgcaacataccagcttgtcgattgttggcgagatgacgttaactatcgaccattgtttgttggtctccggcactactgatttatccaccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttgggaagcgaagctggcggcactttgtacggtttgcaggtactggagcgtattgaagcaaatcagcgacaaaacttcacccgatttgtggtgttggcgcgtaaagccattaacgtgtctgatcaggttccggcgaaaaccacgttgttaatggcgaccgggcaacaagccggtgcgctggttgaagcgttgctggtactgcgcaaccacaatctgattatgacccgtctggaatcacgcccgattcacggtaatccatgggaagagatgttctatctggatattcaggccaatcttgaatcagcggaaatgcaaaaagcattgaaagagttaggggaaatcacccgttcaatgaaggtattgggctgttacccaagtgagaacgtagtgcctgttgatccaacctgatgaaaaggtgccggatgatgtgaatcatccggcactggattattactggcgattgtcattcgcctgacgcaataacacgcggctttcactctgaaaacgctgtgcgtaatcgccgaaccagtgctccaccttgcggaaactgtcaataaacgcctgcttatcgccctgctccagcaactcaatcgcctcgccgaaacgcttatagtaacgtttgattaacgccagattacgctctgacgacataatgatgtcggcataaagctgcggatcctgagcaaacagtcgcccgaccatcgccagctcaaggcggtaaatcggcgaagagagcgccagaagttgctcaagctgaacattttcttctgccaggtgcagcccgtaagcaaaagtagcaaagtggcgcagtgcctgaataaacgccatattctgatcgtgctcgacggcgctaatacgatgcagccgagcgccccagacctgaatttgctccagaaaccattggtatgcttccggtttacgtccatcacaccagaccacaacttgctttgccaggctaccgctgtccggaccgaacatcgggtgtagccccagcaccggaccatcatgcgccaccagcatggcctgtaatggcccatttttcactgatgccagatcgaccagaatacaatctttcggtaaaggcggtaatttgccaataacttgctcagtaacgtggattggcacactaacaatcaccattccggcatcggcaacaatatcagccgctcgatcccagtcatgttgctccagaatccgcacctgataacccgagagggtcagcatcttctcgaacaggcgtcccatctgaccgccaccgccgacgataaccaccggacgcagtgacggacaaagtgttttaaatcctttgtcgttttcactggagtaagattcacgcatcacccgacgcaaaacatcctcaatcagatctggcggtacacccagagcttccgcctctgcacgacgcgaggccaacatagatgcctcgcgctccggaacataaataggcagtccaaagcggcttttcacctcgcccacttcagcaaccagttccagacgcttcgctaataaattcagcagcgctttatcgacttcatcaatttgatcgcgtaatgcggtcaattcagcaaccataataaacctcttaagccacgcgagccgtcagctgcccgttcagatcctgatgaatttcacgcagcaaggcatcggtcatttcccagctaatgc

SEQ ID NO: 36 - DNA, 20 bp, Artificial Sequence
  Description of Artificial Sequence: Synthetic primer
gcattagctgggaaatgacc

SEQ ID NO: 37 - DNA, 20 bp, Artificial Sequence
  Description of Artificial Sequence: Synthetic primer
ttgaagcgttgctggtactg

SEQ ID NO: 38 - DNA, 1484 bp, Artificial Sequence
  Description of Artificial Sequence: Synthetic polynucleotide
gcattagctgggaaatgaccgatgccttgctgcgtgaaattcatcaggatctgaacgggcagctgacggctcgcgtggcttaagaggtttattatggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacactttgtccgtcactgcgtccggtggttatcgtcggcggtggcggtcagatgggacgcctgttcgagaagatgctgaccctctcgggttatcaggtgcggattctggagcaacatgactgggatcgagcggctgatattgttgccgatgccggaatggtgattgttagtgtgccaatccacgttactgagcaagttattggcaaattaccgcctttaccgaaagattgtattctggtcgatctggcatcagtgaaaaatgggccattacaggccatgctggtggcgcatgatggtccggtgctggggctacacccgatgttcggtccggacagcggtagcctggcaaagcaagttgtggtctggtgtgatggacgtaaaccggaagcataccaatggtttctggagcaaattcaggtctggggcgctcggctgcatcgtattagcgccgtcgagcacgatcagaatatggcgtttattcaggcactgcgccactttgctacttttgcttacgggctgcacctggcagaagaaaatgttcagcttgagcaacttctggcgctctcttcgccgatttaccgccttgagctggcgatggtcgggcgactgtttgctcaggatccgcagctttatgccgacatcattatgtcgtcagagcgtaatctggcgttaatcaaacgttactataagcgtttcggcgaggcgattgagttgctggagcagggcgataagcaggcgtttattgacagtttccgcaaggtggagcactggttcggcgattacgcacagcgttttcagagtgaaagccgcgtgttattgcgtcaggcgaatgacaatcgccagtaataatccagtgccggatgattcacatcatccggcaccttttcatcaggttggatcaacaggcactacgttctcacttgggtaacagcccaataccttcattgaacgggtgatttcccctaactctttcaatgctttttgcatttccgctgattcaagattggcctgaatatccagatagaacatctcttcccatggattaccgtgaatcgggcgtgattccagacgggtcataatcagattgtggttgcgcagtaccagcaacgcttcaa

SEQ ID NO: 39 - DNA, 20 bp, Artificial Sequence
  Description of Artificial Sequence: Synthetic primer
tgcccactggcttaggaata

SEQ ID NO: 40 - DNA, 20 bp, Artificial Sequence
  Description of Artificial Sequence: Synthetic primer
tattcctaagccagtgggca

SEQ ID NO: 41 - DNA, 1749 bp, Artificial Sequence
  Description of Artificial Sequence: Synthetic polynucleotide
ggcatggaagagatgaccagccagctgcagtccatgttccagaacctgggcggccagaagcaaaaagcgcgtaagctgaaaatcaaagacgccatgaagctgctgattgaagaagaagcggcgaaactggtgaacccggaagagctgaagcaagacgctatcgacgctgttgagcagcacgggatcgtgtttatcgacgaaatcgacaaaatctgtaagcgcggcgagtcttccggtccggatgtttctcgtgaaggcgttcagcgtgacctgctgccgctggtagaaggttgcaccgtttccaccaaacacgggatggtcaaaactgaccacattctgtttatcgcttctggcgcgttccagattgcgaaaccgtctgacctgatcccggaactgcaaggtcgtctgccaatccgcgttgaactgcaggcgctgaccaccagcgacttcgagcgtattctgaccgagccgaatgcctctatcaccgtgcagtacaaagcactgatggcgactgaaggcgtaaatatcgagtttaccgactccggtattaaacgcatcgcggaagcggcatggcaggtgaacgaatctaccgaaaacatcggtgctcgtcgtttacacactgttctggagcgtttaatggaagagatttcctacgacgccagcgatttaagcggtcaaaatatcactattgacgcagattatgtgagcaaacatctggatgcgttggtggcagatgaagatctgagccgttttatcctataatcgcgttcaatcattttcatcattgtttgatggggctgaaaggccccatttttattggcgcgtattatgactgaacaacaaattagccgaactcaggcgtggctggaaagtttacgacctaaaaccctccccctcgcctttgctgcaattatcgtcgggacagcgctggcatggtggcaaggtcacttcgatccgctggtcgccctgctggcactaattaccgccgggctattacagatcctttctaacctcgccaatgattacggcgatgcggtaaaaggcagcgataaacctgaccgcattgggccgctacgcggcatgcaaaaaggggtcattacccagcaagagatgaaacgggcgctcattattaccgtcgtgctcatctgtctctccgggctggcactggttgcagtggcatgccatacgctggccgattttgtcggtttcctgattcttggcgggttgtcgatcattgccgctatcacctacaccgtgggcaatcgtccttatggttatatcggtctgggtgatatttccgtactggttttctttggctggttgagtgtcatggggagctggtatttacaggctcatacattgattccggcactgatccttccggcgaccgcatgcggcctgctggcaacggcagtactgaatattaataacctgcgtgatatcaatagcgaccgcgaaaatggcaaaaacacgctggtggtgcgcttaggtgaagtgaacgcgcgtcgttatcatgcctgcctgctgatgggctcgctggtgtgtctggcgctgtttaatctcttttcgctgcatagcctgtggggctggctgttcctgctggcggcaccattactggtgaagcaagcccgttatgtgatgcgggaaatggacccggtggcgatgcgaccaatgctggaacgtactgtcaagggagcgttactgactaacctgctgtttgttttagggatattcctaagccagtgggca

SEQ ID NO: 42 - DNA, 20 bp, Artificial Sequence
  Description of Artificial Sequence: Synthetic primer
aaacatctggatgcgttggt

SEQ ID NO: 43 - DNA, 20 bp, Artificial Sequence
  Description of Artificial Sequence: Synthetic primer
ttctcgcagcaactgaatgt

SEQ ID NO: 44 - DNA, 1132 bp, Artificial Sequence
  Description of Artificial Sequence: Synthetic polynucleotide
aaacatctggatgcgttggtggcagatgaagatctgagccgttttatcctataatcgcgttcaatcattttcatcattgtttgatggggctgaaaggccccatttttattggcgcgtattatgactgaacaacaaattagccgaactcaggcgtggctggaaagtttacgacctaaaaccctccccctcgcctttgctgcaattatcgtcgggacagcgctggcatggtggcaaggtcacttcgatccgctggtcgccctgctggcactaattaccgccgggctattacagatcctttctaacctcgccaatgattacggcgatgcggtaaaaggcagcgataaacctgaccgcattgggccgctacgcggcatgcaaaaaggggtcattacccagcaagagatgaaacgggcgctcattattaccgtcgtgctcatctgtctctccgggctggcactggttgcagtggcatgccatacgctggccgattttgtcggtttcctgattcttggcgggttgtcgatcattgccgctatcacctacaccgtgggcaatcgtccttatggttatatcggtctgggtgatatttccgtactggttttctttggctggttgagtgtcatggggagctggtatttacaggctcatacattgattccggcactgatccttccggcgaccgcatgcggcctgctggcaacggcagtactgaatattaataacctgcgtgatatcaatagcgaccgcgaaaatggcaaaaacacgctggtggtgcgcttaggtgaagtgaacgcgcgtcgttatcatgcctgcctgctgatgggctcgctggtgtgtctggcgctgtttaatctcttttcgctgcatagcctgtggggctggctgttcctgctggcggcaccattactggtgaagcaagcccgttatgtgatgcgggaaatggacccggtggcgatgcgaccaatgctggaacgtactgtcaagggagcgttactgactaacctgctgtttgttttagggatattcctaagccagtgggcagcataactgacaaatatcaattaacaattgatgattttgccaacagcccacatagcgcgatatactgaaaattctcgcagcaactgaatgt

SEQ ID NO: 45 - DNA, 20 bp, Artificial Sequence
  Description of Artificial Sequence: Synthetic primer
aaaatcattgcttcggttgc

SEQ ID NO: 46 - DNA, 20 bp, Artificial Sequence
  Description of Artificial Sequence: Synthetic primer
tttatcccttctccacaccg

SEQ ID NO: 47 - DNA, 1907 bp, Artificial Sequence
  Description of Artificial Sequence: Synthetic polynucleotide
aaaatcattgcttcggttgcagaaaaatttatctgtattgcagacgcttccaagcaggttgatattctgggtaaattcccgctgccagtagaagttatcccgatggcacgtagtgcagtggcgcgtcagctggtgaaactgggcggtcgtccggaataccgtcagggcgtggtgaccgataatggcaacgtgatcctcgacgtccacggcatggaaatccttgacccgatagcgatggaaaacgccataaatgcgattcctggcgtggtgactgttggcttgtttgctaaccgtggcgcggacgttgcgctgattggcacacctgacggtgtcaaaaccattgtgaaatgatctgacgggggaacctcccccgttaaaaaaattctcttcattaaatttggtgacatgtgtcacgcttttaccaggcaattgtcgattgctctaaataaatcctctaaaccagcatattcatccaagaattacctttgcgtgatatttcctcaacatcgcgacgcaaacgttcatattgccgcaatattattttttgatatgttgaaaggcggatgcaaatccgcacacaacatttcaaaagacaggattgggtaaatggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaaccaggttgatctggatgcggcggcaaagcgcgggatcccggtatttaacgcaccgttctcaaatacgcgctctgttgcggagctggtgattggcgaactgctgctgctattgcgcggcgtgccggaagccaatgctaaagcgcaccgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaataaactgccgctgggcaacgccactcaggtacagcatctttctgacctgctgaatatgagcgatgtggtgagtctgcatgtaccagagaatccgtccaccaaaaatatgatgggcgcgaaagaaatttcactaatgaagcccggctcgctgctgattaatgcttcgcgcggtactgtggtggatattccggcgctgtgtgatgcgctggcgagcaaacatctggcgggggcggcaatcgacgtattcccgacggaaccggcgaccaatagcgatccatttacctctccgctgtgtgaattcgacaacgtccttctgacgccacacattggcggttcgactcaggaagcgcaggagaatatcggcctggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctgaacaaaatcttcgccgagcagggcgtcaacatcgccgcgcaatatctgcaaacttccgcccagatgggttatgtggttattgatattgaagccgacgaagacgttgccgaaaaagcgctgcaggcaatgaaagctattccgggtaccattcgcgcccgtctgctgtactaattccccttctctgaaaatcaacgggcaggtcactgacttgcccgtttttttatcccttctccacaccg

SEQ ID NO: 48 - DNA, 20 bp, Artificial Sequence
  Description of Artificial Sequence: Synthetic primer
tccggcaacatcaaattaca

SEQ ID NO: 49 - DNA, 20 bp, Artificial Sequence
  Description of Artificial Sequence: Synthetic primer
tctttcagagcaaccgcttt

SEQ ID NO: 50 - DNA, 2379 bp, Artificial Sequence
  Description of Artificial Sequence: Synthetic polynucleotide
tccggatgtttccatccggcaacatcaaattacagcaccttatgcgggccaaagcattcgtaatgaatgttttcctgcttcacgcccagatccactaactgtttcgcggtaaactgcatgaagccaaccgggccgcagagatagaactgcattgtcggatcgctgaacgcaccttccagtttgctcaaatccatcagaccttcgctatcaaactgacctttagcgcgatcggcttcgctcggctgacgataccaggtgtgcgcggtaaagcgcggcagtgactgccccagttccttaacttcatcggcaaaggcgtgaacatcgccattttctgccgcatggaaccagttcacttgtgctgtgtggcctgcttttgccagcgtgtcgagcattgccagcattggcgtttgaccaacaccggcagagattaacgtcactggtgtgtcatctgcgacagccataaagaaatcacctgccggagcgaccagtttcacgacatcgccaacattggcgtgattgtgcaaccagttggatacctgcccaccctcttcgcgtttcaccgcaatacgatagcctttgccatccggtttgcgagtcaaagagtactgacgaatttcctgatgtgggaaaccttccggcttcagccagacgccgagatattgccccggacggtattctgccactgcgccaccgtcgaccggctccagttcgaagctggtgataagcgcgctgcgcggtgttttagccacaatgcggaaatcgcgagtaccttcccaaccaccggctttgctggcgttttcgttatagatttccgcctcgcgattgataaatacattagccagtacaccataggctttaccccacgcgtccagcacttcctgccccgggctgaacatttcgtccagcgttgccaacaggtgttcaccgacgatgttgtactgttccggtttgatctggaagctggtgtgcttctgcgcgattttttctaccgctggcagcagcgcaggcaggttttcaatattactggcgtaggcggcaatagcgttaaacagggcttcacgttgatcgccattacgctggttactcatgttaaaaatttctttgagttctgggttatgagtaaacatacggtcgtagaaatgggcggttaactttggccccgtttccaccagtaaagggatggtggcttttactgtagcgatggtttgagcgtcaagcatatggtcttcctttttttgcatcttaattgatgtatctcaaatgcatcttataaaaaatagccctgcaatgtaaatggttctttggtgtttttcagaaagaatgtgatgaagtgaaaaatttgcatcacaaacctgaaaagaaatccgtttccggttgcaagctctttattctccaaagccttgcgtagcctgaaggtaatcgtttgcgtaaattcctttgtcaagacctgttatcgcacaatgattcggttatactgttcgccgttgtccaacaggaccgcctataaaggccaaaaattttattgttagctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgctgctggaaccaggtgataccgttctgggtatgaacctggcgcatggcggtcacctgactcacggttctccggttaacttctccggtaaactgtacaacatcgttccttacggtatcgatgctaccggtcatatcgactacgccgatctggaaaaacaagccaaagaacacaagccgaaaatgattatcggtggtttctctgcatattccggcgtggtggactgggcgaaaatgcgtgaaatcgctgacagcatcggtgcttacctgttcgttgatatggcgcacgttgcgggcctggttgctgctggcgtctacccgaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaag

SEQ ID NO: 51 - DNA, 20 bp, Artificial Sequence
  Description of Artificial Sequence: Synthetic primer
agcgttaaacagggcttcac

SEQ ID NO: 52 - DNA, 20 bp, Artificial Sequence
  Description of Artificial Sequence: Synthetic primer
gttttgtaggccggataagg

SEQ ID NO: 53 - DNA, 1839 bp, Artificial Sequence
  Description of Artificial Sequence: Synthetic polynucleotide
agcgttaaacagggcttcacgttgatcgccattacgctggttactcatgttaaaaatttctttgagttctgggttatgagtaaacatacggtcgtagaaatgggcggttaactttggccccgtttccaccagtaaagggatggtggcttttactgtagcgatggtttgagcgtcaagcatatggtcttcctttttttgcatcttaattgatgtatctcaaatgcatcttataaaaaatagccctgcaatgtaaatggttctttggtgtttttcagaaagaatgtgatgaagtgaaaaatttgcatcacaaacctgaaaagaaatccgtttccggttgcaagctctttattctccaaagccttgcgtagcctgaaggtaatcgtttgcgtaaattcctttgtcaagacctgttatcgcacaatgattcggttatactgttcgccgttgtccaacaggaccgcctataaaggccaaaaattttattgttagctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgctgctggaaccaggtgataccgttctgggtatgaacctggcgcatggcggtcacctgactcacggttctccggttaacttctccggtaaactgtacaacatcgttccttacggtatcgatgctaccggtcatatcgactacgccgatctggaaaaacaagccaaagaacacaagccgaaaatgattatcggtggtttctctgcatattccggcgtggtggactgggcgaaaatgcgtgaaatcgctgacagcatcggtgcttacctgttcgttgatatggcgcacgttgcgggcctggttgctgctggcgtctacccgaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcgatggagcctgagttcaaaacttaccagcagcaggtcgctaaaaacgctaaagcgatggtagaagtgttcctcgagcgcggctacaaagtggtttccggcggcactgataaccacctgttcctggttgatctggttgataaaaacctgaccggtaaagaagcagacgccgctctgggccgtgctaacatcaccgtcaacaaaaacagcgtaccgaacgatccgaagagcccgtttgtgacctccggtattcgtgtaggtactccggcgattacccgtcgcggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataagcgaaacggtgatttgctgtcaatgtgctcgttgttcatgccggatgcggcgtgaacgccttatccggcctacaaaac

SEQ ID NO: 54 - DNA, 20 bp, Artificial Sequence
  Description of Artificial Sequence: Synthetic primer
gtttaaggaacgcgcttcag

SEQ ID NO: 55 - DNA, 20 bp, Artificial Sequence
  Description of Artificial Sequence: Synthetic primer
gacgcaaacgcacacctaat

SEQ ID NO: 56 - DNA, 1251 bp, Artificial Sequence
  Description of Artificial Sequence: Synthetic polynucleotide
gtttaaggaacgcgcttcagccagcagttgctgctcgcgcttaaggcgacgcttctgattgaagaactctacgctcttactgaagaagattgcccaggtgactacggaggccaaaataagcccaatcatcacgcacttaacgacaatatcggcgtgctgatacataccccagacggaaaggtccgtctgcattaaattattacccactgtgtatctccaggacgcaagtcacaaaatctgcgcataataatatcaaaacgacgtcgaattgatagtcgttctcattactatttgcatactgccgtacctttgctttcttttccttgcgtttacgcagtaaaaaagtcaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtc

SEQ ID NO: 57 - DNA, 19 bp, Artificial Sequence
  Description of Artificial Sequence: Synthetic primer
agcgcgaggcatctatgtt

SEQ ID NO: 58 - DNA, 20 bp, Artificial Sequence
  Description of Artificial Sequence: Synthetic primer
atcagcggaaatgcaaaaag

SEQ ID NO: 59 - DNA, 1131 bp, Artificial Sequence
  Description of Artificial Sequence: Synthetic polynucleotide
agcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacactttgtccgtcactgcgtccggtggttatcgtcggcggtggcggtcagatgggacgcctgttcgagaagatgctgaccctctcgggttatcaggtgcggattctggagcaacatgactgggatcgagcggctgatattgttgccgatgccggaatggtgattgttagtgtgccaatccacgttactgagcaagttattggcaaattaccgcctttaccgaaagattgtattctggtcgatctggcatcagtgaaaaatgggccattacaggccatgctggtggcgcatgatggtccggtgctggggctacacccgatgttcggtccggacagcggtagcctggcaaagcaagttgtggtctggtgtgatggacgtaaaccggaagcataccaatggtttctggagcaaattcaggtctggggcgctcggctgcatcgtattagcgccgtcgagcacgatcagaatatggcgtttattcaggcactgcgccactttgctacttttgcttacgggctgcacctggcagaagaaaatgttcagcttgagcaacttctggcgctctcttcgccgatttaccgccttgagctggcgatggtcgggcgactgtttgctcaggatccgcagctttatgccgacatcattatgtcgtcagagcgtaatctggcgttaatcaaacgttactataagcgtttcggcgaggcgattgagttgctggagcagggcgataagcaggcgtttattgacagtttccgcaaggtggagcactggttcggcgattacgcacagcgttttcagagtgaaagccgcgtgttattgcgtcaggcgaatgacaatcgccagtaataatccagtgccggatgattcacatcatccggcaccttttcatcaggttggatcaacaggcactacgttctcacttgggtaacagcccaataccttcattgaacgggtgatttcccctaactctttcaatgctttttgcatttccgctgat

SEQ ID NO: 60 - DNA, 25 bp, Artificial Sequence
  Description of Artificial Sequence: Synthetic primer
tgcctgtgtaaataaaaatgtacga

SEQ ID NO: 61 - DNA, 20 bp, Artificial Sequence
  Description of Artificial Sequence: Synthetic primer
gcctgttgatccaacctgat

SEQ ID NO: 62 - DNA, 2382 bp, Artificial Sequence
  Description of Artificial Sequence: Synthetic polynucleotide
tgcctgtgtaaataaaaatgtacgaaatatggattgaaaactttactttatgtgttatcgttacgtcatcctcgctgaggatcaactatcgcaaacgagcataaacaggatcgccatcatgcaaaaagacgcgctgaataacgtacatattaccgacgaacaggttttaatgactccggaacaactgaaggccgcttttccattgagcctgcaacaagaagcccagattgctgactcgcgtaaaagcatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcaccgttttgttggcattaaccaggcagggcaggttgcgttgctacaaactcaggggaatccggacggccatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaagaggtttattatggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacactttgtccgtcactgcgtccggtggttatcgtcggcggtggcggtcagatgggacgcctgttcgagaagatgctgaccctctcgggttatcaggtgcggattctggagcaacatgactgggatcgagcggctgatattgttgccgatgccggaatggtgattgttagtgtgccaatccacgttactgagcaagttattggcaaattaccgcctttaccgaaagattgtattctggtcgatctggcatcagtgaaaaatgggccattacaggccatgctggtggcgcatgatggtccggtgctggggctacacccgatgttcggtccggacagcggtagcctggcaaagcaagttgtggtctggtgtgatggacgtaaaccggaagcataccaatggtttctggagcaaattcaggtctggggcgctcggctgcatcgtattagcgccgtcgagcacgatcagaatatggcgtttattcaggcactgcgccactttgctacttttgcttacgggctgcacctggcagaagaaaatgttcagcttgagcaacttctggcgctctcttcgccgatttaccgccttgagctggcgatggtcgggcgactgtttgctcaggatccgcagctttatgccgacatcattatgtcgtcagagcgtaatctggcgttaatcaaacgttactataagcgtttcggcgaggcgattgagttgctggagcagggcgataagcaggcgtttattgacagtttccgcaaggtggagcactggttcggcgattacgcacagcgttttcagagtgaaagccgcgtgttattgcgtcaggcgaatgacaatcgccagtaataatccagtgccggatgattcacatcatccggcaccttttcatcaggttggatcaacaggc

SEQ ID NO: 63 - DNA, 21 bp, Artificial Sequence
  Description of Artificial Sequence: Synthetic primer
aacctgcaaagagacgctatc

SEQ ID NO: 64 - DNA, 20 bp, Artificial Sequence
  Description of Artificial Sequence: Synthetic primer
atcgagttttggttgggatg

SEQ ID NO: 65 - DNA, 1867 bp, Artificial Sequence
  Description of Artificial Sequence: Synthetic polynucleotide
aacctgcaaagagacgctatcgcagctgcgatagatgttctcaatgaagaacgtgtcatcgcctatccaacggaagccgttttcggtgttgggtgcgatcctgatagcgaaacagcagtgatgcgactgttggagttaaaacagcgtccggttgataaggggctgattttaatcgcagcaaattacgagcagcttaaaccctatattgatgacaccatgttgactgacgtgcagcgtgaaaccattttttcccgctggccaggtcctgtcacctttgtctttcccgcgcctgcgacaacaccgcgctggttgacgggccgctttgattcgcttgctgtacgagtcaccgaccatccgttggtggttgctttgtgccaggcttatggtaaaccgctggtttctaccagtgccaacttgagtggattgccaccttgtcgaacagtagacgaagttcgcgcacaatttggcgcggcgttcccggttgtgcctggtgaaacgggggggcgtttaaatccttcagaaatccgcgatgccctgacgggtgaactgtttcgacaggggtaacataatggaaacctatgctgtttttggtaatccgatagcccacagcaaatcgccattcattcatcagcaatttgctcagcaactgaatattgaacatccctatgggcgcgtgttggcacccatcaatgatttcatcaacacactgaacgctttctttagtgctggtggtaaaggtgcgaatgtgacggtgccttttaaagaagaggcttttgccagagcggatgagcttactgaacgggcagcgttggctggtgctgttaataccctcatgcggttagaagatggacgcctgctgggtgacaataccgatggtgtaggcttgttaagcgatctggaacgtctgtcttttatccgccctggtttacgtattctgcttatcggcgctggtggagcatctcgcggcgtactactgccactcctttccctggactgtgcggtgacaataactaatcggacggtatcccgcgcggaagagttggctaaattgtttgcgcacactggcagtattcaggcgttgagtatggacgaactggaaggtcatgagtttgatctcattattaatgcaacatccagtggcatcagtggtgatattccggcgatcccgtcatcgctcattcatccaggcatttattgctatgacatgttctatcagaaaggaaaaactccttttctggcatggtgtgagcagcgaggctcaaagcgtaatgctgatggtttaggaatgctggtggcacaggcggctcatgcctttcttctctggcacggtgttctgcctgacgtagaaccagttataaagcaattgcaggaggaattgtccgcgtgaatcaggccatccagtttccggacagggaagagtgggacgagaataaaaaatgtgtatgttttcccgctctcgtgaatggtatgcaactgacatgcgcgatctctggcgagagtctggcgtatcgctttactggagatacgccagaacagtggttagcgagttttcgtcagcatcgctgggacctggaagaagaagcggaaaacttaattcaggaacaaagtgaagatgatcaaggctgggtctggttaccctgatccagatattcgtccttccatttcacgtaattattcgcggaatagcgtaacccagccttctcttcatcacttaacgggcggatctgtttgacggggctaccgagatacagatatccgctctccagccgtttattttgtgggaccagactacccgcaccaatcatcacatcatcttctactattgcgccatcaagtaaaattgagcccatcccaaccaaaactcgat

SEQ ID NO: 66 - DNA, 20 bp, Artificial Sequence
  Description of Artificial Sequence: Synthetic primer
atatcgccctgcacaacatt

SEQ ID NO: 67 - DNA, 20 bp, Artificial Sequence
  Description of Artificial Sequence: Synthetic primer
tgcgtaatcaggtgtcggta

SEQ ID NO: 68 - DNA, 1066 bp, Artificial Sequence
  Description of Artificial Sequence: Synthetic polynucleotide
atatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttagggaaaaatgcctgatagcgcttcgcttatcaggcctacccgcgcgacaacgtcatttgtggttcggcaaaatcttccagaatgcctcaattagcggctcatgtagccgctttttctgcgcacacacgcccagctcaaacggcgttttctcatcgctgcgctctaaaatcatcacgcggttacgcaccggttcggggctgttttccagcaccacttccggcaacaatgccacgccacagccgagtgccaccatcgataccatcgcttcatgcccgccaaccgtggcgtaaatcatcgggttactgattttattgcgtcgaaaccacagttcaatgcggcggcgtaccggcccctgatcggccataataaacggcaccgttgaccagtccggcttctctaccgacacctgattacgca

SEQ ID NO: 69 - DNA, 19 bp, Artificial Sequence
  Description of Artificial Sequence: Synthetic primer
aggtaagcgatgccgaact

SEQ ID NO: 70 - DNA, 20 bp, Artificial Sequence
  Description of Artificial Sequence: Synthetic primer
tgcgtaatcaggtgtcggta

SEQ ID NO: 71 - DNA, 2139 bp, Artificial Sequence
  Description of Artificial Sequence: Synthetic polynucleotide
aggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaataatggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttagggaaaaatgcctgatagcgcttcgcttatcaggcctacccgcgcgacaacgtcatttgtggttcggcaaaatcttccagaatgcctcaattagcggctcatgtagccgctttttctgcgcacacacgcccagctcaaacggcgttttctcatcgctgcgctctaaaatcatcacgcggttacgcaccggttcggggctgttttccagcaccacttccggcaacaatgccacgccacagccgagtgccaccatcgataccatcgcttcatgcccgccaaccgtggcgtaaatcatcgggttactgattttattgcgtcgaaaccacagttcaatgcggcggcgtaccggcccctgatcggccataataaacggcaccgttgaccagtccggcttctctaccgacacctgattacgca

SEQ ID NO: 72 - DNA, 20 bp, Artificial Sequence
  Description of Artificial Sequence: Synthetic primer
attgcgcagacggataaaac

SEQ ID NO: 73 - DNA, 20 bp, Artificial Sequence
  Description of Artificial Sequence: Synthetic primer
gaacaatccaaaccggtgac

SEQ ID NO: 74 - DNA, 1348 bp, Artificial Sequence
  Description of Artificial Sequence: Synthetic polynucleotide
attgcgcagacggataaaacggtgcctgcggaaggaaattaatccgctttgggaaggcatttacaggaggtaacatgaaaaaacgctttatttatcacgatgaaaaatcgaataaattttggtggatagattacgaaggggatagtttagctgtcaactatggcaaggtaggtagtattggtaaattccagacaaaagagttcgataatgaagaacagtgtctgaaagaagccagtaaattgattgccgcaaaaatgaagaaaggctatcaagaagatccaaagtttaacttcatggatcgctactattttgatgatgaagaaattgggttacatgttaaaacgtcacacccaaacttccagtgccattttactgatccactttatatgtgttgctgggatgaagaatctccttttggcagcgatgaaggtgctgatgctctaaacgttcttgaaaatagcctccgtaaagagccggatctggactgtgctgatttccctcaaatgttaattgaaactatgtggggtatgaaatacatcgctatggacagtattcttgaagaggatgttcgtgcgcaattactagtcgatgaaatgagcactatccagagcaatatgattacctacgcaactgcattcggtcagattaaagtcatgggtaaaatctcccataaacttaaaaagatgggactcaatgcactagcgcgtcatcagcttaccgcaaaaattcttcaatggggtgacggtcaggactcaccaatacttcaaaaaatgattgatgaccttacggcgtttcctcacgaaaattaaatactgcatttgtcggcagcaacaactgttaaaaaagtgcgctttgtttatgccggatgcggcgtaaacgccttatccggcctacaaaatcgtgctaattcaatatattgcagaaaccttgtaggcctgataagcgtagcgcatcaggcagttttgcgtttgtcatcagtctccgatgctattaatccttaaatccccgccccctggctaaaatgctcttccccaaacaccccggtagaaaggtagcgatcgccacgatcgcagatgatcgccaccaccaccgcgtcagggttagcttttgccacccgcagtgctccggcaaccgcgccgccggagctgacgccacagaatattccttcccgcaccgccagttcgcgcatggtgttttccgcatcgcgctgatgaatatccagcacctcatccaccagagaagcgttgaaaatccccggcagatattccgtaggccagcggcgaatgccgggaatgctgctgccctcttccggttgcaggccgacaatggtcaccggtttggattgttc

SEQ ID NO: 75 - DNA, 26 bp, Artificial Sequence
  Description of Artificial Sequence: Synthetic primer
ggtcaggtatgatttaaatggtcagt

SEQ ID NO: 76 - DNA, 21 bp, Artificial Sequence
  Description of Artificial Sequence: Synthetic primer
cagtccagttacgctggagtc

SEQ ID NO: 77 - DNA, 2123 bp, Artificial Sequence; identical to SEQ ID NO: 20
  Description of Artificial Sequence: Synthetic polynucleotide

SEQ ID NO: 78 - DNA, 26 bp, Artificial Sequence
  Description of Artificial Sequence: Synthetic primer
ggtcaggtatgatttaaatggtcagt

SEQ ID NO: 79 - DNA, 21 bp, Artificial Sequence
  Description of Artificial Sequence: Synthetic primer
cagtccagttacgctggagtc

SEQ ID NO: 80 - DNA, 1251 bp, Artificial Sequence; identical to SEQ ID NO: 56
  Description of Artificial Sequence: Synthetic polynucleotide

SEQ ID NO: 81 - DNA, 20 bp, Artificial Sequence
  Description of Artificial Sequence: Synthetic primer
ttcttaaggaaagcataaaa

SEQ ID NO: 82 - DNA, 26 bp, Artificial Sequence
  Description of Artificial Sequence: Synthetic primer
gggatctagatcaaatctccctaaac

SEQ ID NO: 83 - DNA, 1017 bp, Artificial Sequence
  Description of Artificial Sequence: Synthetic polynucleotide
ttcttaaggaaagcataaaaaaaacatgcatacaacaatcagaacggttctgtctgcttgcttttaatgccataccaaacgtaccattgagacacttgtttgcacagaggatggcccatgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaaagtttagggagatttgatccc

SEQ ID NO: 84 - DNA, 19 bp, Artificial Sequence
  Description of Artificial Sequence: Synthetic primer
attaaaagtattttccgag

SEQ ID NO: 85 - DNA, 27 bp, Artificial Sequence
  Description of Artificial Sequence: Synthetic primer
gggatctagagcaaaaaagggaagtgg

SEQ ID NO: 86 - DNA, 2281 bp, Artificial Sequence
  Description of Artificial Sequence: Synthetic polynucleotide
attaaaagtattttccgaggctcctcctttcattttgtcccatgtgttgggaggggccttttttacctggagatatgactatgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgaagatattgctaataagatcaagcagaccactgacgaatatatcaacactattctgcctccgctgactaaagcactgtttaaatatgttcgtgaaggtaaatatactttctgtactcctggtcacatgggcggtactgcattccagaaaagcccggtaggtagcctgttctatgatttctttggtccgaataccatgaaatctgatatttccatttcagtatctgaactgggttctctgctggatcacagtggtccacacaaagaagcagaacagtatatcgctcgcgtctttaacgcagaccgcagctacatggtgaccaacggtacttccactgcgaacaaaattgttggtatgtactctgctccagcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggcggcgttctctcaggcttccatgatccacgttaaaggtgacgtaaacgaagaaacctttaacgaagcctacatgatgcacaccaccacttctccgcactacggtatcgtggcgtccactgaaaccgctgcggcgatgatgaaaggcaatgcaggtaagcgtctgatcaacggttctattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgactttaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagtgctgccgacgatggtaatgactccgtatgctgcattccagaaagagctgcacggtatgaccgaagaagtttacctcgacgaaatggtaggtcgtattaacgccaatatgatccttccgtacccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaataattagctcgtacaagggaagtggcttgccacttcccttttttgctctagatccc

SEQ ID NO: 87 - DNA, 20 bp, Artificial Sequence
  Description of Artificial Sequence: Synthetic primer
acgttgctaaaatgtgaatt

SEQ ID NO: 88 - DNA, 25 bp, Artificial Sequence
  Description of Artificial Sequence: Synthetic primer
gggatctagatattacagacaaaaa

SEQ ID NO: 89 - DNA, 1409 bp, Artificial Sequence
  Description of Artificial Sequence: Synthetic polynucleotide
acgttgctaaaatgtgaattcagcaatgattgcgaggttatcgcaagaaaacgttttcgcgaggttgatgcggtgctttcctggctgttagaatacgccccgtcgcgcctgactgggacaggggcctgtgtctttgctgaatttgatacagagtctgaagcccgccaggtgctagagcaagccccggaatggctcaatggctttgtggcgaaaggcgctaatctttccccattgcacagagccatgctttaagccgggcaagctgagtttcggtgacaacgtcaccttgttccagacgttgcatcgcgctctttaatacaccgcctggaaaggatcatgcctggcccgcacagttttcggcagattctttccaccaatggacgcatgcctgaggttcttctcgtgcctgatatgaagctttttgctggtaacgccaccccggaactagcacaacgtattgccaaccgcctgtacacttcactcggcgacgccgctgtaggtcgctttagcgatggcgaagtcagcgtacaaattaatgaaaatgtacgcggtggtgatattttcatcatccagtccacttgtgcccctactaacgacaacctgatggaattagtcgttatggttgatgccctgcgtcgtgcttccgcaggtcgtatcaccgctgttatcccctactttggctatgcgcgccaggaccgtcgcgtccgttccgctcgtgtaccaatcactgcgaaagtggttgcagacttcctctccagcgtcggtgttgaccgtgtgctgacagtggatctgcacgctgaacagattcagggtttcttcgacgttccggttgataacgtatttggtagcccgatcctgctggaagacatgctgcagctgaatctggataacccaattgtggtttctccggacatcggcggcgttgtgcgtgcccgcgctatcgctaagctgctgaacgataccgatatggcaatcatcgacaaacgtcgtccgcgtgcgaacgtttcacaggtgatgcatatcatcggtgacgttgcaggtcgtgactgcgtactggtcgatgatatgatcgacactggcggtacgctgtgtaaagctgctgaagctctgaaagaacgtggtgctaaacgtgtatttgcgtacgcgactcacccgatcttctctggcaacgcggcgaacaacctgcgtaactctgtaattgatgaagtcgttgtctgcgataccattccgctgagcgatgaaatcaaatcactgccgaacgtgcgtactctgaccctgtcaggtatgctggccgaagcgattcgtcgtatcagcaacgaagaatcgatctctgccatgttcgaacactaatcgaacccggctcaaagacccgctgcggcgggtttttttgtctgtaatatctagatccc

SEQ ID NO: 90 - DNA, 20 bp, Artificial Sequence
  Description of Artificial Sequence: Synthetic primer
ctaaggtgcgcgaaagccac

SEQ ID NO: 91 - DNA, 27 bp, Artificial Sequence
  Description of Artificial Sequence: Synthetic primer
gggatctagatcctggcacagcagttg

SEQ ID NO: 92 - DNA, 3906 bp, Artificial Sequence
  Description of Artificial Sequence: Synthetic polynucleotide
ctaaggtgcgcgaaagccactttttccttcctgagttatccacaaagttatgcacttgcaagagggtcattttcacactatcttgcagtgaatcccaaacataccccctatatatagtgttctaagcagcttcccgtactacaggtagtctgcatgaaactattgcggaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgatggcccgcgttaccctgcgcatcactggcacacaactgctgtgccaggatctagatccc

SEQ ID NO: 93 - DNA, 19 bp, Artificial Sequence
  Description of Artificial Sequence: Synthetic primer
atgataataaatacgcgtc

SEQ ID NO: 94 - DNA, 27 bp, Artificial Sequence
  Description of Artificial Sequence: Synthetic primer
gggatctagatcaccacaaattatttg

SEQ ID NO: 95 - DNA, 4076 bp, Artificial Sequence
  Description of Artificial Sequence: Synthetic polynucleotide
atgataataaatacgcgtctttgaccccgaagcctgtcttcggggtttctttttgcctggtgaatcacaaaaatccccctaccccgtcacgctcatatccagggtaatttcgaccactatttgctatatattgtgtggttgaatcttttttcaactacatctagtatctctgtatcaacagagagacaacccgacgcgtatcatcgcgccgtatcttcattttaaacggaaatacgaatcatgcgcattactatttacactcgtaacgattgcgttcagtgccacgccaccaaacgggcgatggaaaaccggggctttgattttgaaatgattaatgtcgatcgcgttcctgaagcggcagaagcgttgcgtgctcagggctttcgtcagttgccggtagtgattgctggcgatcttagctggtctggtttccgtccggacatgattaaccgtctgcatccagcgccacacgcggccagtgcatgagccagctcgtctacttctccagcagctccgaaaacacgcagcgttttatcgaacgtttaggtctgcccgcggtgcgcatcccgctcaatgagcgggaacggattcaggtagacgagccttacatcctgatcgtgccctcttacggcggcggcggtacggctggcgcggtgccacgacaggtaattcgctttttaaacgacgagcacaaccgggcgttgcttcgcggcgttattgcttctggtaatcgcaactttggtgaggcgtatggccgcgccggagatgtgattgcccggaaatgcggcgtgccgtggctgtaccgttttgaactcatgggtacgcaaagcgatatcgaaaacgttcgtaaaggagtaaccgaattttggcaacgacaaccgcagaatgcctgacgcaggaaacgatggattaccacgcgctgaatgcgatgcttaacctctacgatagcgcaggtcgcattcagttcgataaagaccgccaggccgttgacgcctttattgcgacgcatgtgcgtccgaacagtgtgaccttcagtagccagcagcagcgcctgaactggctggtcaacgaaggttactatgatgaaagcgttcttaatcgctactctcgcgactttgtcattacgctgtttacccacgcacacaccagcggttttcgtttccagacattcctcggggcatggaagttttacaccagctatacgttgaagacattcgacggtaaacgttatctggaagattttgccgatcgagtaacgatggtggcgctgacgctggcacaaggcgatgagacgctggcgttgcaactgaccgatgaaatgctgtcaggacgctttcagccagccacgccaacattcctcaactgcggtaagcagcagcgcggcgaactggtttcctgttttttgctgcgtattgaagacaatatggagtcgattggtcgggcggtaaattccgcactgcagctgtcgaaacgcggcggcggcgtagcatttttgctgtcgaatctgcgagaagcgggcgcgccaattaaacgtattgaaaatcaatcttctggcgtaattccggtgatgaaaatgctggaagacgcattttcctatgccaaccaactcggcgctcgtcagggggctggtgcagtctatttacatgctcatcatcccgatattctgcgttttctcgacacgaaacgggaaaatgccgacgaaaaaatccgcattaaaacactgtcgcttggcgtggtgatcccggatatcactttccatctggcaaaagagaatgcgcagatggcgctgttttcgccttatgacgtagagcgagtttatggcaagccgtttgccgatgtggccatcagccaacactatgacgaactggttgccgatgaacgcattcgcaaaaaatacctcaacgcccgtgatttcttccagcgactggcagaaatccagtttgagtccggctatccctacatcatgtatgaagacacggtaaaccgtgctaaccctatcgccgggcgcataaatatgagtaatctctgctcagaaattttgcaggttaacagcgcctcagagtatgacgagaatctcgactatacccgcacaggccatgatatttcctgcaatttaggttcgttgaatattgcgcacaccatggattcccccgattttgcccgcacggtagagactgccgtgcgcggtttaacggcagtatcagatatgagtcatatccgcagcgtgccgtccatcgaagccggaaatgccgcctcgcacgccatcggactggggcagatgaatttacacggctatctggcgcgagaaggcatcgcttatggttcgccggaagcactggatttcaccaatctctatttctatgccatcacctggcatgcactgcgtacctcgatgttgctggcacgcgaacgcggtgaaaccttcgccgggttcaaacagtcacgctatgccagtggtgaatattttagccaatatctgcaagggaactggcagccgaaaacggcgaaagttggcgaactgtttacccgtagcggtattacgttacctacccgtgagatgtgggcgcagctgcgcgacgacgtgatgcgctacggcatatacaaccagaatcttcaggcggtgccgccaaccggttctatctcttatatcaaccatgctacgtcgagtattcatccgattgtggcgaaagtagagatacgcaaagagggcaaaacaggacgcgtttactaccctgccccgtttatgactaacgagaatctggcgctgtatcaggacgcttacgaaattggcgcagaaaagatcatcgacacctacgcggaagcgactcgccatgtcgatcaggggctgtcgctgacgctttttttccccgataccgccaccactcgcgatatcaacaaagcgcagatttacgcctggcgcaagggtatcaaaacgctctattacatccgcctgcgtcagatggcgctggaaggcactgaaattgaaggctgcgtctcctgtgcactttaaggaatatctatgaaactctcacgtatcagcgccatcaactggaacaagatatctgacgataaagatctggaggtgtggaatcgcctgaccagcaatttctggctaccagaaaaggtgccgctgtcgaacgatattcctgcctggcagacattaactgtcgtagaacaacaactgacgatgcgcgtttttactggcctgacgctgctcgacacgctgcaaaatgttatcggcgcgccttctctgatgcccgatgcactcacgcctcatgaagaagcggtattatcgaatatcagctttatggaagcggttcatgcccgctcttacagttcgattttctcgacgctatgccagaccaaagatgtcgatgccgcctacgcctggagtgaagaaaacgcaccgttgcagcgaaaagctcagattattcagcaacattatcgcggtgatgatccgctgaaaaagaaaatcgccagtgtgtttcttgaatcttttttgttctattccggtttctggctgccgatgtatttttccagccgcggaaagctgaccaataccgcggacctgatccgtctgattatccgcgatgaagcagtccacggttactacataggctataaatatcagaaaaacatggaaaagatatctctgggacaacgtgaagagttgaagagtttcgccttcgatttgttgctggaactctacgacaacgagttgcaatacaccgatgagctgtacgccgaaaccccgtgggctgacgatgtgaaagcgtttctctgttacaacgccaataaggctttgatgaatctgggctacgaaccgttatttcccgcagaaatggcggaagtgaatccggcaatcctcgccgcgctttcgccgaatgccgatgaaaatcacgatttcttttccggttcaggctcctcttatgtgatggggaaagcggttgaaacagaagatgaagactggaatttctgagggtgttattttcaaaaatatcactacccgcagcagggaaataattcccgccaaatagctttttatcacgcaaataatttgtggtgatctagatccc

SEQ ID NO: 96 - DNA, 20 bp, Artificial Sequence
  Description of Artificial Sequence: Synthetic primer
caatatgacgtaagttaacg

SEQ ID NO: 97 - DNA, 28 bp, Artificial Sequence
  Description of Artificial Sequence: Synthetic primer
gggatctagacgctggtacgtcgtcatt

SEQ ID NO: 98 - DNA, 1496 bp, Artificial Sequence
  Description of Artificial Sequence: Synthetic polynucleotide
caatatgacgtaagttaacggcggccattagcgctctctcgcaatccggtaatccatatcatttttgcatagactcgacataaatcgatattttttattctttttatgatgtggcgtaatcataaaaaagcacttatctggagtttgttatgccacattcactgttcagcaccgataccgatctcaccgccgaaaatctgctgcgtttgcccgctgaatttggctgcccggtgtgggtctacgatgcgcaaattattcgtcggcagattgcagcgctgaaacagtttgatgtggtgcgctttgcacagaaagcctgttccaatattcatattttgcgcttaatgcgtgagcagggcgtgaaagtggattccgtctcgttaggcgaaatagagcgtgcgttggcggcgggttacaatccgcaaacgcaccccgatgatattgtttttacggcagatgttatcgatcaggcgacgcttgaacgcgtcagtgaattgcaaattccggtgaatgcgggttctgttgatatgctcgaccaactgggccaggtttcgccagggcatcgggtatggctgcgcgttaatccggggtttggtcacggacatagccaaaaaaccaataccggtggcgaaaacagcaagcacggtatctggtacaccgatctgcccgccgcactggacgtgatacaacgtcatcatctgcagctggtcggcattcacatgcacattggttctggcgttgattatgcccatctggaacaggtgtgtggtgctatggtgcgtcaggtcatcgaattcggtcaggatttacaggctatttctgcgggcggtgggctttctgttccttatcaacagggtgaagaggcggttgataccgaacattattatggtctgtggaatgccgcgcgtgagcaaatcgcccgccatttgggccaccctgtgaaactggaaattgaaccgggtcgcttcctggtagcgcagtctggcgtattaattactcaggtgcggagcgtcaaacaaatggggagccgccactttgtgctggttgatgccgggttcaacgatctgatgcgcccggcaatgtacggtagttaccaccatatcagtgccctggcagctgatggtcgttctctggaacacgcgccaacggtggaaaccgtcgtcgccggaccgttatgtgaatcgggcgatgtctttacccagcaggaagggggaaatgttgaaacccgcgccttgccggaagtgaaggcaggtgattatctggtactgcatgatacaggggcatatggcgcatcaatgtcatccaactacaatagccgtccgctgttaccagaagttctgtttgataatggtcaggcgcggttgattcgccgtcgccagaccatcgaagaattactggcgctggaattgctttaactgcggttagtcgctggttgcatgatgacttgcctccagcgacggagttgacactgaatgacgacgtaccagcgtctagatccc

SEQ ID NO: 99 - DNA, 26 bp, Artificial Sequence
  Description of Artificial Sequence: Synthetic primer
ggtcaggtatgatttaaatggtcagt

SEQ ID NO: 100 - DNA, 21 bp, Artificial Sequence
  Description of Artificial Sequence: Synthetic primer
cagtccagttacgctggagtc

SEQ ID NO: 101 - DNA, 2123 bp, Artificial Sequence; identical to SEQ ID NO: 20
  Description of Artificial Sequence: Synthetic polynucleotide

SEQ ID NO: 102 - DNA, 24 bp, Artificial Sequence
  Description of Artificial Sequence: Synthetic primer
gctgtgcaggtcgtaaatcactgc

SEQ ID NO: 103 - DNA, 20 bp, Artificial Sequence
  Description of Artificial Sequence: Synthetic primer
gccaccctccgggccgttgc

SEQ ID NO: 104 - DNA, 1903 bp, Artificial Sequence
  Description of Artificial Sequence: Synthetic polynucleotide
gctgtgcaggtcgtaaatcactgcataattcgtgtcgctcaaggcgcctcccgttctggatatgttttttgcgccgacatcataacgggttctggcaaatattctgaaatgagctgttgacaattaatcatcggctcgtataatgtgtggaattgtgagcggataacaatttcacacaggaaacagaattccctgagacttgtaatgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgacctgtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctgaatgcgtgcccattcctgacggaatgggcatttctgcgcaacttgttgtcttctcaacaaattactgcttgctctggtcagccataatattgataataagaatcattgttatatcaattattattaatttttatgcgttatacggatagcagaaaactcacgcctgaaacggatgccaatcacaagaccgcttccccgcagcctattcggcgaattcttgaagacgaaagggcctcgtgatacgcctatttttataggttaatgtcatgataataatggtttcttaggggatccgtcgacctgcagccaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagaactgggcctttcgttttatctgttgtttgtcggtgaacgctctcctgagtaggacaaatccgccgggagcggatttgaacgttgcgaagcaacggcccggagggtggc

SEQ ID NO: 105 - DNA, 25 bp, Artificial Sequence
  Description of Artificial Sequence: Synthetic primer
ggacccgggatcaagtgaagaaaac

SEQ ID NO: 106 - DNA, 24 bp, Artificial Sequence
  Description of Artificial Sequence: Synthetic primer
ggtaacccgggtggtgtcgaacgt

SEQ ID NO: 107 - DNA, 1377 bp, Artificial Sequence
  Description of Artificial Sequence: Synthetic polynucleotide
ggacccgggatcaagtgaagaaaaccgatcttgatgctgaactgcaacaacagttccttgaagagttcgaggcaggtttgtacggttatacttatcttgaagatgagtaagtcctgtgttacttgaatccgcttaatttagcggtgataatccgccacaatttattgtgacaaatccaacccttcctcgtcgggcctaacgacgcggaagggtttttttatatcgactttgtaataggagtccatccatgagcaccttaggtcatcaatacgataactcactggtttccaatgcctttggttttttacgcctgccgatgaacttccagccgtatgacagcgatgcagactgggtgattactggcgtgccgttcgatatggccacttctggtcgtgcgggtggtcgccacggtccggcagcgatccgtcaggtttcgacgaatctggcctgggaacacaaccgcttcccgtggaatttcgacatgcgtgagcgtctgaacgtcgtggactgcggcgatctggtatatgcctttggcgatgcccgtgagatgagcgaaaagctgcaggcgcacgccgagaagctgctggctgccggtaagcgtatgctctctttcggtggtgaccactttgttacgctgccgctgctgcgtgctcatgcgaagcatttcggcaaaatggcgctggtacactttgacgcccacaccgatacctatgcgaacggttgtgaatttgaccacggcactatgttctataccgcgccgaaagaaggtctgatcgacccgaatcattccgtgcagattggtattcgtaccgagtttgataaagacaacggctttaccgtgctggacgcctgccaggtgaacgatcgcagcgtggatgacgttatcgcccaagtgaaacagattgtgggtgatatgccggtttacctgacttttgatatcgactgcctggatcctgcttttgcaccaggcaccggtacgccagtgattggcggcctgacctccgatcgcgctattaaactggtacgcggcctgaaagatctcaacattgttgggatggacgtagtggaagtggctccggcatacgatcagtcggaaatcactgctctggcagcggcaacgctggcgctggaaatgctgtatattcaggcggcgaaaaagggcgagtaagcaccagatgcgatgcgcacgggtaaaacgtgccattaatgtcggatgcggcgtgaacgccttatccgacctacgttcggcacccgtaggccggataagatgcgccagcatcgcatccggcaatgcgcacaaggtaacaaatgtgccattcatgtcagatgcggcgtgaacgccttatctgacctacgttcgacaccacccgggttacc

SEQ ID NO: 108 - DNA, 24 bp, Artificial Sequence
  Description of Artificial Sequence: Synthetic primer
gctgtgcaggtcgtaaatcactgc

SEQ ID NO: 109 - DNA, 20 bp, Artificial Sequence
  Description of Artificial Sequence: Synthetic primer
gccaccctccgggccgttgc

SEQ ID NO: 110 - DNA, 2982 bp, Artificial Sequence
  Description of Artificial Sequence: Synthetic polynucleotide
gctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagaattcccggggatgaataaacttgccgccttccctaaattcaaaatccataggatttacatataattagaggaagaaaaaatgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttatgcggagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaaaatccaaaccgggtggtaataccacccggtcttttctcattacagcgacttcttcccaccatactgcttaaaccattccagcatacgctgccagccatcttctgcagccaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggc

SEQ ID NO: 111 - DNA, 26 bp, Artificial Sequence
  Description of Artificial Sequence: Synthetic primer
ggtcaggtatgatttaaatggtcagt

SEQ ID NO: 112 - DNA, 21 bp, Artificial Sequence
  Description of Artificial Sequence: Synthetic primer
cagtccagttacgctggagtc

SEQ ID NO: 113 - DNA, 1251 bp, Artificial Sequence; identical to SEQ ID NO: 56
  Description of Artificial Sequence: Synthetic polynucleotide

SEQ ID NO: 114 - DNA, 26 bp, Artificial Sequence
  Description of Artificial Sequence: Synthetic primer
ggtcaggtatgatttaaatggtcagt

SEQ ID NO: 115 - DNA, 21 bp, Artificial Sequence
  Description of Artificial Sequence: Synthetic primer
cagtccagttacgctggagtc

SEQ ID NO: 116 - DNA, 2123 bp, Artificial Sequence; identical to SEQ ID NO: 20
  Description of Artificial Sequence: Synthetic polynucleotide

SEQ ID NO: 117 - DNA, 24 bp, Artificial Sequence
  Description of Artificial Sequence: Synthetic primer
gctgtgcaggtcgtaaatcactgc

SEQ ID NO: 118 - DNA, 20 bp, Artificial Sequence
  Description of Artificial Sequence: Synthetic primer
gccaccctccgggccgttgc

SEQ ID NO: 119 - DNA, 1903 bp, Artificial Sequence; identical to SEQ ID NO: 104
  Description of Artificial Sequence: Synthetic polynucleotide

SEQ ID NO: 120 - DNA, 25 bp, Artificial Sequence
  Description of Artificial Sequence: Synthetic primer
ggacccgggatcaagtgaagaaaac

SEQ ID NO: 121 - DNA, 24 bp, Artificial Sequence
  Description of Artificial Sequence: Synthetic primer
ggtaacccgggtggtgtcgaacgt

SEQ ID NO: 122 - DNA, 1377 bp, Artificial Sequence; identical to SEQ ID NO: 107
  Description of Artificial Sequence: Synthetic polynucleotide

SEQ ID NO: 123 - DNA, 19 bp, Artificial Sequence
  Description of Artificial Sequence: Synthetic primer
cgcggtatcattgcagcac

SEQ ID NO: 124 - DNA, 31 bp, Artificial Sequence
  Description of Artificial Sequence: Synthetic primer
gcatcggctcttccgcgtcaagtcagcgtaa

SEQ ID NO: 125 - DNA, 21 bp, Artificial Sequence
  Description of Artificial Sequence: Synthetic primer
aacgaattcaagcttgatatc

SEQ ID NO: 126 - DNA, 23 bp, Artificial Sequence
  Description of Artificial Sequence: Synthetic primer
gaattcgttgacgaattctctag

SEQ ID NO: 127 - DNA, 87 bp, Artificial Sequence
  Description of Artificial Sequence: Synthetic primer
aattcgtggaagaaaggggagatgaagccggcattacgcgatttcatcgccattgtgcaggaacgtttggcaagcgtaacggcataa

SEQ ID NO: 128 - DNA, 87 bp, Artificial Sequence
  Description of Artificial Sequence: Synthetic primer
agctttatgccgttacgcttgccaaacgttcctgcacaatggcgatgaaatcgcgtaatgccggcttcatctcccctttcttccacg

SEQ ID NO: 129 - protein, 21 aa, Escherichia coli
MKPALRDFIAIVQERLASVTA

SEQ ID NO: 130 - DNA, 19 bp, Artificial Sequence
  Description of Artificial Sequence: Synthetic primer
aaggtcggtgctcatcaag

SEQ ID NO: 131 - DNA, 17 bp, Artificial Sequence
  Description of Artificial Sequence: Synthetic primer
ctggttgctggataacc

SEQ ID NO: 132 - DNA, 20 bp, Artificial Sequence
  Description of Artificial Sequence: Synthetic primer
atatgaatattggaacaggc

SEQ ID NO: 133 - DNA, 22 bp, Artificial Sequence
  Description of Artificial Sequence: Synthetic primer
acgcgttacaccatggaacagg

SEQ ID NO: 134 - DNA, 19 bp, Artificial Sequence
  Description of Artificial Sequence: Synthetic primer
ctgacggcacgactcggga

SEQ ID NO: 135 - DNA, 21 bp, Artificial Sequence
  Description of Artificial Sequence: Synthetic primer
ctgccgatctgccgttcgccc

SEQ ID NO: 136 - DNA, 20 bp, Artificial Sequence
  Description of Artificial Sequence: Synthetic primer
agcagcttataacgccggac

SEQ ID NO: 137 - DNA, 21 bp, Artificial Sequence
  Description of Artificial Sequence: Synthetic primer
tggtcccgtgatgtcgcgtta

SEQ ID NO: 138 - DNA, 20 bp, Artificial Sequence
  Description of Artificial Sequence: Synthetic primer
gatggtggcctgtttacgcg

SEQ ID NO: 139 - DNA, 20 bp, Artificial Sequence
  Description of Artificial Sequence: Synthetic primer
gatcgctttactttgcgatg

SEQ ID NO: 140 - DNA, 19 bp, Artificial Sequence
  Description of Artificial Sequence: Synthetic primer
gattttgactgtttcttga

SEQ ID NO: 141 - DNA, 20 bp, Artificial Sequence
  Description of Artificial Sequence: Synthetic primer
cgaggcaaccacgcgcgcta

SEQ ID NO: 142 - DNA, 30 bp, Artificial Sequence
  Description of Artificial Sequence: Synthetic primer
gggaactagtctttgtaataggagtccatc

SEQ ID NO: 143 - DNA, 27 bp, Artificial Sequence
  Description of Artificial Sequence: Synthetic primer
gggaagcatgcgcatcgcatctggtgc

SEQ ID NO: 144 - DNA, 979 bp, Artificial Sequence
  Description of Artificial Sequence: Synthetic polynucleotide
gggaactagtctttgtaataggagtccatccatgagcaccttaggtcatcaatacgataactcactggtttccaatgcctttggttttttacgcctgccgatgaacttccagccgtatgacagcgatgcagactgggtgattactggcgtgccgttcgatatggccacttctggtcgtgcgggtggtcgccacggtccggcagcgatccgtcaggtttcgacgaatctggcctgggaacacaaccgcttcccgtggaatttcgacatgcgtgagcgtctgaacgtcgtggactgcggcgatctggtatatgcctttggcgatgcccgtgagatgagcgaaaagctgcaggcgcacgccgagaagctgctggctgccggtaagcgtatgctctctttcggtggtgaccactttgttacgctgccgctgctgcgtgctcatgcgaagcatttcggcaaaatggcgctggtacactttgacgcccacaccgatacctatgcgaacggttgtgaatttgaccacggcactatgttctataccgcgccgaaagaaggtctgatcgacccgaatcattccgtgcagattggtattcgtaccgagtttgataaagacaacggctttaccgtgctggacgcctgccaggtgaacgatcgcagcgtggatgacgttatcgcccaagtgaaacagattgtgggtgatatgccggtttacctgacttttgatatcgactgcctggatcctgcttttgcaccaggcaccggtacgccagtgattggcggcctgacctccgatcgcgctattaaactggtacgcggcctgaaagatctcaacattgttgggatggacgtagtggaagtggctccggcatacgatcagtcggaaatcactgctctggcagcggcaacgctggcgctggaaatgctgtatattcaggcggcgaaaaagggcgagtaagcaccagatgcgatgcgcatgcttccc

SEQ ID NO: 145 - DNA, 29 bp, Artificial Sequence
  Description of Artificial Sequence: Synthetic primer
gggaactagtaggatttacatataattag

SEQ ID NO: 146 - DNA, 29 bp, Artificial Sequence
  Description of Artificial Sequence: Synthetic primer
gggaagcatgcggtattaccacccggttt

SEQ ID NO: 147 - DNA, 2336 bp, Artificial Sequence
  Description of Artificial Sequence: Synthetic polynucleotide
gggaactagtaggatttacatataattagaggaagaaaaaatgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaaaatccaaaccgggtggtaataccgcatgcttccc

SEQ ID NO: 148 - DNA, 27 bp, Artificial Sequence
  Description of Artificial Sequence: Synthetic primer
ggaaggatccatgtccggtacgggtcg

SEQ ID NO: 149 - DNA, 26 bp, Artificial Sequence
  Description of Artificial Sequence: Synthetic primer
gggattagacggtaatcgcacgaccg

SEQ ID NO: 150 - DNA, 7794 bp, Artificial Sequence
  Description of Artificial Sequence: Synthetic polynucleotide
ggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacttgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtcaccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatttttttttcctcctcggcgtttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggcgctgacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccatttttttttcctcctttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatttttttttcctcctttaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattgaggggtgtcgcccttattcgactctatagtgaagttcctattctctagaaagtataggaacttctgaagtggggtttaaactccctctgcccttccctcccgcttcatccttatttttggacaataaactagagaacaatttgaacttgaattggaattcagattcagagcaagagacaagaaacttccctttttcttctccacatattattatttattcgtgtattttcttttaacgatacgatacgatacgacacgatacgatacgacacgctactatacagtgacgtcagattgtactgagagtgcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacaggtgtgaaataccgcacagtcatgagatccgataacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaacggatccgaatactagttggccaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagcttggccaccacacaccatagcttcaaaatgtttctactccttttttactcttccagattttctcggactccgcgcatcgccgtaccacttcaaaacacccaagcacagcatactaaattttccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaatttttttttttagtttttttctctttcagtgacctccattgatatttaagttaataaacggtcttcaatttctcaagtttcagtttcatttttcttgttctattacaactttttttacttcttgttcattagaaagaaagcatagcaatctaatctaagggatgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataagtttaaacaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgct

SEQ ID NO: 151 - DNA, 3710 bp, Artificial Sequence
  Description of Artificial Sequence: Synthetic polynucleotide
gatcggatccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtcggatctagatctcaccatcaccaccattaaactagtgatc

SEQ ID NO: 152 - DNA, 6477 bp, Artificial Sequence
  Description of Artificial Sequence: Synthetic polynucleotide
aaactccctctgcccttccctcccgcttcatccttatttttggacaataaactagagaacaatttgaacttgaattggaattcagattcagagcaagagacaagaaacttccctttttcttctccacatattattatttattcgtgtattttcttttaacgatacgatacgatacgacacgatacgatacgacacgctactatacagtgacgtcagattgtactgagagtgcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacaggtgtgaaataccgcacagtcatgagatccgataacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaacggatccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtcggatctagatctcaccatcaccaccattaaactagttggccaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagcttggccaccacacaccatagcttcaaaatgtttctactccttttttactcttccagattttctcggactccgcgcatcgccgtaccacttcaaaacacccaagcacagcatactaaattttccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaatttttttttttagtttttttctctttcagtgacctccattgatatttaagttaataaacggtcttcaatttctcaagtttcagtttcatttttcttgttctattacaactttttttacttcttgttcattagaaagaaagcatagcaatctaatctaagggatgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataagttt

SEQ ID NO: 153 - DNA, 6233 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatagccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatgagtgtgcgtaatgagttgtaaaattatgtataaacctactttctctcacaagttatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcactaagaaaccattattatcatgacattaacctataaaaataggcgtatcacgaggccctttcgtc

SEQ ID NO: 154 - DNA, 12710 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatagccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatgagtgtgcgtaatgagttgtaaaattatgtataaacctactttctctcacaagttatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccaaactccctctgcccttccctcccgcttcatccttatttttggacaataaactagagaacaatttgaacttgaattggaattcagattcagagcaagagacaagaaacttccctttttcttctccacatattattatttattcgtgtattttcttttaacgatacgatacgatacgacacgatacgatacgacacgctactatacagtgacgtcagattgtactgagagtgcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacaggtgtgaaataccgcacagtcatgagatccgataacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaacggatccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtcggatctagatctcaccatcaccaccattaaactagttggccaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagcttggccaccacacaccatagcttcaaaatgtttctactccttttttactcttccagattttctcggactccgcgcatcgccgtaccacttcaaaacacccaagcacagcatactaaattttccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaatttttttttttagtttttttctctttcagtgacctccattgatatttaagttaataaacggtcttcaatttctcaagtttcagtttcatttttcttgttctattacaactttttttacttcttgttcattagaaagaaagcatagcaatctaatctaagggatgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataagtttgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcactaagaaaccattattatcatgacattaacctataaaaataggcgtatcacgaggccctttcgtc

SEQ ID NO: 155 - DNA, 23 bp, Artificial Sequence
  Description of Artificial Sequence: Synthetic primer
gacaatatacaaacgcgattctc

SEQ ID NO: 156 - DNA, 23 bp, Artificial Sequence
  Description of Artificial Sequence: Synthetic primer
tgagactgaaatattgacgttga

SEQ ID NO: 157 - DNA, 21 bp, Artificial Sequence
  Description of Artificial Sequence: Synthetic primer
cccggttttcttttttttcac

SEQ ID NO: 158 - DNA, 24 bp, Artificial Sequence
  Description of Artificial Sequence: Synthetic primer
cgagagaattaccttttcttgaag

SEQ ID NO: 159 - DNA, 22 bp, Artificial Sequence
  Description of Artificial Sequence: Synthetic primer
gatgcactaatttaagggaagc

SEQ ID NO: 160 - DNA, 20 bp, Artificial Sequence
  Description of Artificial Sequence: Synthetic primer
gaaaacgaatgttgaatgcg

SEQ ID NO: 161 - DNA, 25 bp, Artificial Sequence
  Description of Artificial Sequence: Synthetic primer
cagatctacgtcacaccgtaatttg

SEQ ID NO: 162 - DNA, 25 bp, Artificial Sequence
  Description of Artificial Sequence: Synthetic primer
atcaaatactaccaactcacttgaa

SEQ ID NO: 163 - DNA, 25 bp, Artificial Sequence
  Description of Artificial Sequence: Synthetic primer
ctcgatacttttgtcaagcaaggtc

SEQ ID NO: 164 - DNA, 22 bp, Artificial Sequence
  Description of Artificial Sequence: Synthetic primer
tgaaaaactccccccacttaga

SEQ ID NO: 165 - DNA, 25 bp, Artificial Sequence
  Description of Artificial Sequence: Synthetic primer
gttattaatcagctctctgctttgc

SEQ ID NO: 166 - DNA, 22 bp, Artificial Sequence
  Description of Artificial Sequence: Synthetic primer
gtggctaaatcaatcaactggc

SEQ ID NO: 167 - DNA, 25 bp, Artificial Sequence
  Description of Artificial Sequence: Synthetic primer
ctctttctgatacttgattatcggg

SEQ ID NO: 168 - DNA, 25 bp, Artificial Sequence
  Description of Artificial Sequence: Synthetic primer
gttgatgaagtctcagatgttgctc

SEQ ID NO: 169 - DNA, 21 bp, Artificial Sequence
  Description of Artificial Sequence: Synthetic primer
ttaagaaaatgcaacgctgcc

SEQ ID NO: 170 - DNA, 23 bp, Artificial Sequence
  Description of Artificial Sequence: Synthetic primer
caaggcctaatttcagaagacca

SEQ ID NO: 171 - DNA, 24 bp, Artificial Sequence
  Description of Artificial Sequence: Synthetic primer
cagccgttgatcctctctaagtat

SEQ ID NO: 172 - DNA, 22 bp, Artificial Sequence
  Description of Artificial Sequence: Synthetic primer
gcgaaagatacctcgataaagc

SEQ ID NO: 173 - DNA, 23 bp, Artificial Sequence
  Description of Artificial Sequence: Synthetic primer
cgtgtttgatagaaacctccaac

SEQ ID NO: 174 - DNA, 22 bp, Artificial Sequence
  Description of Artificial Sequence: Synthetic primer
tcatggccttcttacaaggaca

SEQ ID NO: 175 - DNA, 23 bp, Artificial Sequence
  Description of Artificial Sequence: Synthetic primer
atttaaaagcttcctcactttcc

SEQ ID NO: 176 - DNA, 21 bp, Artificial Sequence
  Description of Artificial Sequence: Synthetic primer
ttgccaacacttctatgcatg

SEQ ID NO: 177 - DNA, 21 bp, Artificial Sequence
  Description of Artificial Sequence: Synthetic primer
tgttaaaccatcgttttcacg

SEQ ID NO: 178 - DNA, 20 bp, Artificial Sequence
  Description of Artificial Sequence: Synthetic primer
caatggtgccacttttgcta

SEQ ID NO: 179 - DNA, 24 bp, Artificial Sequence
  Description of Artificial Sequence: Synthetic primer
gtaagcggtgtagaattgcgtatt

SEQ ID NO: 180 - DNA, 20 bp, Artificial Sequence
  Description of Artificial Sequence: Synthetic primer
aaggtcaagaacgttggcat

SEQ ID NO: 181 - DNA, 23 bp, Artificial Sequence
  Description of Artificial Sequence: Synthetic primer
aagcatttaatagaacagcatcg

SEQ ID NO: 182 - DNA, 22 bp, Artificial Sequence
  Description of Artificial Sequence: Synthetic primer
tatgcgcctgtgaacattctct

SEQ ID NO: 183 - DNA, 5886 bp, Artificial Sequence
  Description of Artificial Sequence: Synthetic polynucleotide
acggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaaccccggatcggactactagcagctgtaatacgactcactatagggaatattaagctcgcccttaagggcgagcttcgaggtcacccattcgaaggtaagcctatccctaaccctctcctcggtctcgattctacgcgtaccggtcatcatcaccatcaccattgagtttctagagggccgcatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcggccctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagcgcttaccatctggccccagtgctgcaatgataccgcgagacccacgctcaccggctccagatttatcagcaataaaccagccagccggaagggccgagcgcagaagtggtcctgcaactttatccgcctccattcagtctattaattgttgccgggaagctagagtaagtagttcgccagttaatagtttgcgcaacgttgttggcattgctacaggcatcgtggtgtcactctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataatagtgtatcacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctagcttatcgatgataagctgtcaaagatgagaattaattccacggactatagactatactagatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgacgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatgggaagctccaccccggttgataatcagaaaagccccaaaaacaggaagattgtataagcaaatatttaaattgtaaacgttaatattttgttaaaattcgcgttaaatttttgttaaatcagctcattttttaacgaatagcccgaaatcggcaaaatcccttataaatcaaaagaatagaccgagatagggttgagtgttgttccagtttccaacaagagtccactattaaagaacgtggactccaacgtcaaagggcgaaaaagggtctatcagggcgatggcccactacgtgaaccatcaccctaatcaagttttttggggtcgaggtgccgtaaagcagtaaatcggaagggtaaacggatgcccccatttagagcttgacggggaaagccggcgaacgtggcgagaaaggaagggaagaaagcgaaaggagcgggggctagggcggtgggaagtgtaggggtcacgctgggcgtaaccaccacacccgccgcgcttaatggggcgctacagggcgcgtggggatgatccactagt

SEQ ID NO: 184 - DNA, 5797 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 185 - DNA, 6849 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 186 - DNA, 1937 bp, Artificial Sequence
  Description of Artificial Sequence: Synthetic polynucleotide
acagctgtcagcgctaaaagatgcctggcagttccctactctcgccgctgcgctcggtcgttcggctgcgggacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaagcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgcagtgcgactaacggcatgaagctcgtcggggagcgctg

SEQ ID NO: 187 - DNA, 87 bp, Artificial Sequence
  Description of Artificial Sequence: Synthetic primer
aattcgtggaagaaaggggagttgaagccggcattacgcgatttcatcgccattgtgcaggaacgtttggcaagcgtaacggcataa

SEQ ID NO: 188 - DNA, 87 bp, Artificial Sequence
  Description of Artificial Sequence: Synthetic primer
agctttatgccgttacgcttgccaaacgttcctgcacaatggcgatgaaatcgcgtaatgccggcttcaactcccctttcttccacg

SEQ ID NO: 189 - DNA, 8251 bp, Artificial Sequence
  Description of Artificial Sequence: Synthetic polynucleotide
ttcgctagcaggagctaaggaagctaaaatgtccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatccgggcttatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagaa

SEQ ID NO: 190 - DNA, 966 bp, Escherichia coli
atgacaaagtatgcattagtcggtgatgtgggcggcaccaacgcacgtcttgctctgtgtgatattgccagtggtgaaatctcgcaggctaagacctattcagggcttgattaccccagcctcgaagcggtcattcgcgtttatcttgaagaacataaggtcgaggtgaaagacggctgtattgccatcgcttgcccaattaccggtgactgggtggcgatgaccaaccatacctgggcgttctcaattgccgaaatgaaaaagaatctcggttttagccatctggaaattattaacgattttaccgctgtatcgatggcgatcccgatgctgaaaaaagagcatctgattcagtttggtggcgcagaaccggtcgaaggtaagcctattgcggtttacggtgccggaacggggcttggggttgcgcatctggtccatgtcgataagcgttgggtaagcttgccaggcgaaggcggtcacgttgattttgcgccgaatagtgaagaagaggccattatcctcgaaatattgcgtgcggaaattggtcatgtttcggcggagcgcgtgctttctggccctgggctggtgaatttgtatcgcgcaattgtgaaagctgacaaccgcctgccagaaaatctcaagccaaaagatattaccgaacgcgcgctggctgacagctgcaccgattgccgccgcgcattgtcgctgttttgcgtcattatgggccgttttggcggcaatctggcgctcaatctcgggacatttggcggcgtgtttattgcgggcggtatcgtgccgcgcttccttgagttcttcaaagcctccggtttccgtgccgcatttgaagataaagggcgctttaaagaatatgtccatgatattccggtgtatctcatcgtccatgacaatccgggccttctcggttccggtgcacatttacgccagaccttaggtcacattctgtaa

SEQ ID NO: 191 - DNA, 1650 bp, Escherichia coli
atgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaggatctggcgaaagagtgcgatctggcgggcgcgattaagtcgatgttctctggcgagaagatcaaccgcactgaaaaccgcgccgtgctgcacgtagcgctgcgtaaccgtagcaataccccgattttggttgatggcaaagacgtaatgccggaagtcaacgcggtgctggagaagatgaaaaccttctcagaagcgattatttccggtgagtggaaaggttataccggcaaagcaatcactgacgtagtgaacatcgggatcggcggttctgacctcggcccatacatggtgaccgaagctctgcgtccgtacaaaaaccacctgaacatgcactttgtttctaacgtcgatgggactcacatcgcggaagtgctgaaaaaagtaaacccggaaaccacgctgttcttggtagcatctaaaaccttcaccactcaggaaactatgaccaacgcccatagcgcgcgtgactggttcctgaaagcggcaggtgatgaaaaacacgttgcaaaacactttgcggcgctttccaccaatgccaaagccgttggcgagtttggtattgatactgccaacatgttcgagttctgggactgggttggcggccgttactctttgtggtcagcgattggcctgtcgattgttctctccatcggctttgataacttcgttgaactgctttccggcgcacacgcgatggacaagcatttctccaccacgcctgccgagaaaaacctgcctgtactgctggcgctgattggcatctggtacaacaatttctttggtgcggaaactgaagcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtattcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgataaagaaatcagcagccacgatagctcgaccaatggtctgattaaccgctataaagcgtggcgcggttaa

SEQ ID NO: 192 - DNA, 1476 bp, Escherichia coli
atggcggtaacgcaaacagcccaggcctgtgacctggtcattttcggcgcgaaaggcgaccttgcgcgtcgtaaattgctgccttccctgtatcaactggaaaaagccggtcagctcaacccggacacccggattatcggcgtagggcgtgctgactgggataaagcggcatataccaaagttgtccgcgaggcgctcgaaactttcatgaaagaaaccattgatgaaggtttatgggacaccctgagtgcacgtctggatttttgtaatctcgatgtcaatgacactgctgcattcagccgtctcggcgcgatgctggatcaaaaaaatcgtatcaccattaactactttgccatgccgcccagcacttttggcgcaatttgcaaagggcttggcgaggcaaaactgaatgctaaaccggcacgcgtagtcatggagaaaccgctggggacgtcgctggcgacctcgcaggaaatcaatgatcaggttggcgaatacttcgaggagtgccaggtttaccgtatcgaccactatcttggtaaagaaacggtgctgaacctgttggcgctgcgttttgctaactccctgtttgtgaataactgggacaatcgcaccattgatcatgttgagattaccgtggcagaagaagtggggatcgaagggcgctggggctattttgataaagccggtcagatgcgcgacatgatccagaaccacctgctgcaaattctttgcatgattgcgatgtctccgccgtctgacctgagcgcagacagcatccgcgatgaaaaagtgaaagtactgaagtctctgcgccgcatcgaccgctccaacgtacgcgaaaaaaccgtacgcgggcaatatactgcgggcttcgcccagggcaaaaaagtgccgggatatctggaagaagagggcgcgaacaagagcagcaatacagaaactttcgtggcgatccgcgtcgacattgataactggcgctgggccggtgtgccattctacctgcgtactggtaaacgtctgccgaccaaatgttctgaagtcgtggtctatttcaaaacacctgaactgaatctgtttaaagaatcgtggcaggatctgccgcagaataaactgactatccgtctgcaacctgatgaaggcgtggatatccaggtactgaataaagttcctggccttgaccacaaacataacctgcaaatcaccaagctggatctgagctattcagaaacctttaatcagacgcatctggcggatgcctatgaacgtttgctgctggaaaccatgcgtggtattcaggcactgtttgtacgtcgcgacgaagtggaagaagcctggaaatgggtagactccattactgaggcgtgggcgatggacaatgatgcgccgaaaccgtatcaggccggaacctggggacccgttgcctcggtggcgatgattacccgtgatggtcgttcctggaatgagtttgagtaa

SEQ ID NO: 193 - DNA, 1407 bp, Escherichia coli
atgtccaagcaacagatcggcgtagtcggtatggcagtgatgggacgcaaccttgcgctcaacatcgaaagccgtggttataccgtctctattttcaaccgttcccgtgagaagacggaagaagtgattgccgaaaatccaggcaagaaactggttccttactatacggtgaaagagtttgtcgaatctctggaaacgcctcgtcgcatcctgttaatggtgaaagcaggtgcaggcacggatgctgctattgattccctcaaaccatatctcgataaaggagacatcatcattgatggtggtaacaccttcttccaggacactattcgtcgtaatcgtgagctttcagcagagggctttaacttcatcggtaccggtgtttctggcggtgaagagggggcgctgaaaggtccttctattatgcctggtggccagaaagaagcctatgaattggtagcaccgatcctgaccaaaatcgccgccgtagctgaagacggtgaaccatgcgttacctatattggtgccgatggcgcaggtcactatgtgaagatggttcacaacggtattgaatacggcgatatgcagctgattgctgaagcctattctctgcttaaaggtggcctgaacctcaccaacgaagaactggcgcagacctttaccgagtggaataacggtgaactgagcagttacctgatcgacatcaccaaagatatcttcaccaaaaaagatgaagacggtaactacctggttgatgtgatcctggatgaagcggctaacaaaggtaccggtaaatggaccagccagagcgcgctggatctcggcgaaccgctgtcgctgattaccgagtctgtgtttgcacgttatatctcttctctgaaagatcagcgtgttgccgcatctaaagttctctctggtccgcaagcacagccagcaggcgacaaggctgagttcatcgaaaaagttcgtcgtgcgctgtatctgggcaaaatcgtttcttacgcccagggcttctctcagctgcgtgctgcgtctgaagagtacaactgggatctgaactacggcgaaatcgcgaagattttccgtgctggctgcatcatccgtgcgcagttcctgcagaaaatcaccgatgcttatgccgaaaatccacagatcgctaacctgttgctggctccgtacttcaagcaaattgccgatgactaccagcaggcgctgcgtgatgtcgttgcttatgcagtacagaacggtattccggttccgaccttctccgcagcggttgcctattacgacagctaccgtgctgctgttctgcctgcgaacctgatccaggcacagcgtgactattttggtgcgcatacttataagcgtattgataaagaaggtgtgttccataccgaatggctggattaa

SEQ ID NO: 194 - DNA, 678 bp, Escherichia coli
atgaaacagtatttgattgccccctcaattctgtcggctgattttgcccgcctgggtgaagataccgcaaaagccctggcagctggcgctgatgtcgtgcattttgacgtcatggataaccactatgttcccaatctgacgattgggccaatggtgctgaaatccttgcgtaactatggcattaccgcccctatcgacgtacacctgatggtgaaacccgtcgatcgcattgtgcctgatttcgctgccgctggtgccagcatcattacctttcatccagaagcctccgagcatgttgaccgcacgctgcaactgattaaagaaaatggctgtaaagcgggtctggtatttaacccggcgacacctctgagctatctggattacgtgatggataagctggatgtgatcctgctgatgtccgtcaaccctggtttcggcggtcagtctttcattcctcaaacactggataaactgcgcgaagtacgtcgccgtatcgacgagtctggctttgacattcgactagaagtggacggtggcgtgaaggtgaacaacattggcgaaatcgctgcggcgggcgcggatatgttcgtcgccggttcggcaatcttcgaccagccagactacaaaaaagtcattgatgaaatgcgcagtgaactggcaaaggtaagtcatgaataa

SEQ ID NO: 195 - DNA, 660 bp, Escherichia coli
atgacgcaggatgaattgaaaaaagcagtaggatgggcggcacttcagtatgttcagcccggcaccattgttggtgtaggtacaggttccaccgccgcacactttattgacgcgctcggtacaatgaaaggccagattgaaggggccgtttccagttcagatgcttccactgaaaaactgaaaagcctcggcattcacgtttttgatctcaacgaagtcgacagccttggcatctacgttgatggcgcagatgaaatcaacggccacatgcaaatgatcaaaggcggcggcgcggcgctgacccgtgaaaaaatcattgcttcggttgcagaaaaatttatctgtattgcagacgcttccaagcaggttgatattctgggtaaattcccgctgccagtagaagttatcccgatggcacgtagtgcagtggcgcgtcagctggtgaaactgggcggtcgtccggaataccgtcagggcgtggtgaccgataatggcaacgtgatcctcgacgtccacggcatggaaatccttgacccgatagcgatggaaaacgccataaatgcgattcctggcgtggtgactgttggcttgtttgctaaccgtggcgcggacgttgcgctgattggcacacctgacggtgtcaaaaccattgtgaaatga

SEQ ID NO: 196 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattga

SEQ ID NO: 197 - DNA, 1992 bp, Escherichia coli
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggtcacccggaagtgggttacaccgctggtgtggaaaccaccaccggtccgctgggtcagggtattgccaacgcagtcggtatggcgattgcagaaaaaacgctggcggcgcagtttaaccgtccgggccacgacattgtcgaccactacacctacgccttcatgggcgacggctgcatgatggaaggcatctcccacgaagtttgctctctggcgggtacgctgaagctgggtaaactgattgcattctacgatgacaacggtatttctatcgatggtcacgttgaaggctggttcaccgacgacaccgcaatgcgtttcgaagcttacggctggcacgttattcgcgacatcgacggtcatgacgcggcatctatcaaacgcgcagtagaagaagcgcgcgcagtgactgacaaaccttccctgctgatgtgcaaaaccatcatcggtttcggttccccgaacaaagccggtacccacgactcccacggtgcgccgctgggcgacgctgaaattgccctgacccgcgaacaactgggctggaaatatgcgccgttcgaaatcccgtctgaaatctatgctcagtgggatgcgaaagaagcaggccaggcgaaagaatccgcatggaacgagaaattcgctgcttacgcgaaagcttatccgcaggaagccgctgaatttacccgccgtatgaaaggcgaaatgccgtctgacttcgacgctaaagcgaaagagttcatcgctaaactgcaggctaatccggcgaaaatcgccagccgtaaagcgtctcagaatgctatcgaagcgttcggtccgctgttgccggaattcctcggcggttctgctgacctggcgccgtctaacctgaccctgtggtctggttctaaagcaatcaacgaagatgctgcgggtaactacatccactacggtgttcgcgagttcggtatgaccgcgattgctaacggtatctccctgcacggtggcttcctgccgtacacctccaccttcctgatgttcgtggaatacgcacgtaacgccgtacgtatggctgcgctgatgaaacagcgtcaggtgatggtttacacccacgactccatcggtctgggcgaagacggcccgactcaccagccggttgagcaggtcgcttctctgcgcgtaaccccgaacatgtctacatggcgtccgtgtgaccaggttgaatccgcggtcgcgtggaaatacggtgttgagcgtcaggacggcccgaccgcactgatcctctcccgtcagaacctggcgcagcaggaacgaactgaagagcaactggcaaacatcgcgcgcggtggttatgtgctgaaagactgcgccggtcagccggaactgattttcatcgctaccggttcagaagttgaactggctgttgctgcctacgaaaaactgactgccgaaggcgtgaaagcgcgcgtggtgtccatgccgtctaccgacgcatttgacaagcaggatgctgcttaccgtgaatccgtactgccgaaagcggttactgcacgcgttgctgtagaagcgggtattgctgactactggtacaagtatgttggcctgaacggtgctatcgtcggtatgaccaccttcggtgaatctgctccggcagagctgctgtttgaagagttcggcttcactgttgataacgttgttgcgaaagcaaaagaactgctgtaa

SEQ ID NO: 198 - DNA, 2004 bp, Escherichia coli
atgtcccgaaaagaccttgccaatgcgattcgcgcactcagtatggatgcggtacaaaaagccaactctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactgggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccagcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgatcctctcaaggcagaatctggcccaggtggaacgtacgccggatcaggttaaagagattgctcgtggcggttatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctga

SEQ ID NO: 199 - DNA, 951 bp, Escherichia coli
atgaacgagttagacggcatcaaacagttcaccactgtcgtggcagacagcggcgatattgagtccattcgccattatcatccccaggatgccaccaccaatccttcgctgttactcaaagctgccggattatcacaatatgagcatttaatagacgatgctatcgcctggggtaaaaaaaatggcaagacccaggaacaacaggtggtcgcagcgtgtgacaaactggcggtcaatttcggtgctgaaatcctcaaaatcgtacccggtcgcgtgtcaacagaagttgatgcacgcctctcttttgataaagaaaagagtattgagaaggcgcgccatctggtggacttgtatcagcaacaaggcgttgagaaatcacgcattctgatcaagctggcttcgacctgggaaggaattcgcgcggcagaagagctggaaaaagaaggtattaactgcaacctgacgctgctgttttcttttgcacaggcacgggcctgtgcggaagcaggcgtttttctgatttcgccgtttgtcgggcgtatttatgactggtatcaggcacgcaagccgatggacccgtatgtggtggaagaagatccgggcgttaaatcggtgcgcaatatctacgactactataagcaacaccactatgaaaccattgtgatgggcgcgagcttccgtcgcaccgaacaaatcctcgccttaaccggctgcgatcgactgactatcgcaccgaatttactgaaggagctgcaggaaaaagtttcgccagtggtacgtaaattaatcccaccttctcagacgttcccacgcccagctcccatgagcgaagcggagttccgttgggagcacaatcaggatgcgatggcggtagaaaaactgtctgaaggcattcgtctgttcgccgttgatcaacgcaaactggaagatcttcttgccgccaaactataa

SEQ ID NO: 200 - DNA, 954 bp, Escherichia coli
atgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaa

SEQ ID NO: 201 - DNA, 963 bp, Escherichia coli
atgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaa

SEQ ID NO: 202 - DNA, 930 bp, Escherichia coli
atggtacgtatctatacgttgacacttgcgccctctctcgatagcgcaacaattaccccgcaaatttatcccgaaggaaaactgcgctgtaccgcaccggtgttcgaacccgggggcggcggcatcaacgtcgcccgcgccattgcccatcttggaggcagtgccacagcgatcttcccggcgggtggcgcgaccggcgaacacctggtttcactgttggcggatgaaaatgtccccgtcgctactgtagaagccaaagactggacccggcagaatttacacgtacatgtggaagcaagcggtgagcagtatcgttttgttatgccaggcgcggcattaaatgaagatgagtttcgccagcttgaagagcaagttctggaaattgaatccggggccatcctggtcataagcggaagcctgccgccaggtgtgaagctggaaaaattaacccaactgatttccgctgcgcaaaaacaagggatccgctgcatcgtcgacagttctggcgaagcgttaagtgcagcactggcaattggtaacatcgagttggttaagcctaaccaaaaagaactcagtgcgctggtgaatcgcgaactcacccagccggacgatgtccgcaaagccgcgcaggaaatcgttaatagcggcaaggccaaacgggttgtcgtttccctgggtccacaaggagcgctgggtgttgatagtgaaaactgtattcaggtggtgccaccaccggtgaaaagccagagtaccgttggcgctggtgacagcatggtcggcgcgatgacactgaaactggcagaaaatgcctctcttgaagagatggttcgttttggcgtagctgcggggagtgcagccacactcaatcagggaacacgtctgtgctcccatgacgatacgcaaaaaatttacgcttacctttcccgctaa

SEQ ID NO: 203 - DNA, 1080 bp, Escherichia coli
atgtctaagatttttgatttcgtaaaacctggcgtaatcactggtgatgacgtacagaaagttttccaggtagcaaaagaaaacaacttcgcactgccagcagtaaactgcgtcggtactgactccatcaacgccgtactggaaaccgctgctaaagttaaagcgccggttatcgttcagttctccaacggtggtgcttcctttatcgctggtaaaggcgtgaaatctgacgttccgcagggtgctgctatcctgggcgcgatctctggtgcgcatcacgttcaccagatggctgaacattatggtgttccggttatcctgcacactgaccactgcgcgaagaaactgctgccgtggatcgacggtctgttggacgcgggtgaaaaacacttcgcagctaccggtaagccgctgttctcttctcacatgatcgacctgtctgaagaatctctgcaagagaacatcgaaatctgctctaaatacctggagcgcatgtccaaaatcggcatgactctggaaatcgaactgggttgcaccggtggtgaagaagacggcgtggacaacagccacatggacgcttctgcactgtacacccagccggaagacgttgattacgcatacaccgaactgagcaaaatcagcccgcgtttcaccatcgcagcgtccttcggtaacgtacacggtgtttacaagccgggtaacgtggttctgactccgaccatcctgcgtgattctcaggaatatgtttccaagaaacacaacctgccgcacaacagcctgaacttcgtattccacggtggttccggttctactgctcaggaaatcaaagactccgtaagctacggcgtagtaaaaatgaacatcgataccgatacccaatgggcaacctgggaaggcgttctgaactactacaaagcgaacgaagcttatctgcagggtcagctgggtaacccgaaaggcgaagatcagccgaacaagaaatactacgatccgcgcgtatggctgcgtgccggtcagacttcgatgatcgctcgtctggagaaagcattccaggaactgaacgcgatcgacgttctgtaa

SEQ ID NO: 204 - DNA, 1053 bp, Escherichia coli
atgacagatattgcgcagttgcttggcaaagacgccgacaaccttttacagcaccgttgtatgacaattccttctgaccagctttatctccccggacatgactacgtagaccgcgtaatgattgacaataatcgcccgccagcggtgttacgtaatatgcagacgttgtacaacaccgggcgtctggctggcacaggatatctttctattctgccggttgaccagggcgttgagcactctgccggagcttcatttgctgctaacccgctctactttgacccgaaaaacattgttgaactggcgatcgaagcgggctgtaactgtgtggcgtcaacttacggcgtgctggcgtcggtatcgcggcgttatgcgcatcgcattccattcctcgtcaaacttaatcacaacgagacgctaagttacccgaatacctacgatcaaacgctgtatgccagcgtggagcaggcgttcaacatgggcgcggttgcggttggtgcgactatctattttggctcggaagagtcacgtcgccagattgaagaaatttctgcggcttttgaacgtgcgcacgagctgggtatggtgacagtgctgtgggcctatttgcgtaactccgcctttaagaaagatggcgttgattaccatgtttccgccgacctgaccggtcaggcaaaccatctggcggcaaccatcggtgcagatatcgtcaaacaaaaaatggcggaaaataacggcggctataaagcaattaattacggttacaccgacgatcgtgtttacagcaaattgaccagcgaaaacccgattgatctggtgcgttatcagttagctaactgctatatgggtcgggctgggttgataaactccggcggtgctgcgggcggtgaaactgacctcagcgatgcagtgcgtactgcggttatcaacaaacgcgcaggcggaatggggctgattcttggacgtaaagcgttcaagaaatcgatggctgacggcgtgaaactgattaacgccgtgcaggacgtttatctcgatagcaaaattactatcgcctga

SEQ ID NO: 205 - DNA, 768 bp, Escherichia coli
atgcgacatcctttagtgatgggtaactggaaactgaacggcagccgccacatggttcacgagctggtttctaacctgcgtaaagagctggcaggtgttgctggctgtgcggttgcaatcgcaccaccggaaatgtatatcgatatggcgaagcgcgaagctgaaggcagccacatcatgctgggtgcgcaaaacgtggacctgaacctgtccggcgcattcaccggtgaaacctctgctgctatgctgaaagacatcggcgcacagtacatcatcatcggtcactctgaacgtcgtacttaccacaaagaatctgacgaactgatcgcgaaaaaattcgcggtgctgaaagagcagggcctgactccggttctgtgcatcggtgaaaccgaagctgaaaatgaagcgggcaaaactgaagaagtttgcgcacgtcagatcgacgcggtactgaaaactcagggtgctgcggcattcgaaggtgcggttatcgcttacgaacctgtatgggcaatcggtactggcaaatctgcaactccggctcaggcacaggctgttcacaaattcatccgtgaccacatcgctaaagttgacgctaacatcgctgaacaagtgatcattcagtacggcggctctgtaaacgcgtctaacgctgcagaactgtttgctcagccggatatcgacggcgcgctggttggtggtgcttctctgaaagctgacgccttcgcagtaatcgttaaagctgcagaagcggctaaacaggcttaa

SEQ ID NO: 206 - DNA, 996 bp, Escherichia coli
atgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcctctaccggtgctgctaaagctgtaggtaaagtactgccagaactgaatggcaaactgactggtatggcgttccgcgttccgaccccgaacgtatctgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataa

SEQ ID NO: 207 - DNA, 1164 bp, Escherichia coli
atgtctgtaattaagatgaccgatctggatcttgctgggaaacgtgtatttatccgtgcggatctgaacgtaccagtaaaagacgggaaagtaaccagcgacgcgcgtatccgtgcttctctgccgaccatcgaactggccctgaaacaaggcgcaaaagtgatggtaacttcccacctgggtcgtcctaccgaaggcgagtacaacgaagaattctctctgctgccggttgttaactacctgaaagacaaactgtctaacccggttcgtctggttaaagattacctcgacggcgttgacgttgctgaaggtgaactggttgttctggaaaacgttcgcttcaacaaaggcgagaagaaagacgacgaaaccctgtccaaaaaatacgctgcactgtgtgacgtgttcgtaatggacgcattcggtactgctcaccgcgcgcaggcttctactcacggtatcggtaaattcgctgacgttgcgtgcgcaggcccgctgctggcagctgaactggacgcgctgggtaaagcactgaaagaacctgctcgcccgatggtggctatcgttggtggttctaaagtatctaccaaactgaccgttctggactccctgtctaaaatcgctgaccagctgattgttggtggtggtatcgctaacacctttatcgcggcacaaggccacgatgtgggtaaatccctgtacgaagctgacctggttgacgaagctaaacgtctgctgaccacctgcaacatcccggttccgtctgatgttcgcgtagcaaccgagttctctgaaactgcaccggctaccctgaaatctgttaacgatgtgaaagctgacgagcagatcctggatatcggtgatgcttccgctcaggaactggctgaaatcctgaagaatgcgaaaaccattctgtggaacggtccggttggcgtgttcgaattcccgaacttccgcaaaggtactgaaatcgtggctaacgctatcgcagacagcgaagcgttctccatcgctggcggcggcgacactctggcagcaatcgacctgttcggcattgctgacaaaatctcctacatctccactggcggcggcgcattcctcgaattcgtggaaggtaaagtactgcctgcagtagcgatgctcgaagagcgcgctaagaagtaa

SEQ ID NO: 208 - DNA, 648 bp, Escherichia coli
atgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacgcacccggcgtacggcggaaatcatcgcccaggcctgcggctgtgacatcatctttgattctcgcctgcgtgaattaaacatgggtgtgctggaaaaaagacatatcgattctctgaccgaagaagaagagaactggcgtcggcagctggtcaatggcaccgttgacgggcgtattcctgaaggcgagtcaatgcaggagctcagcgatcgcgtcaatgcggcactggaatcttgccgggacttaccgcagggaagccgaccgctgctggtgagtcatggtattgcactgggatgcctggtgagtacgattctcggattaccagcatgggcagagcgccgcttacgtctgcgtaactgttctatttcgcgcgtggattatcaggaaagcctgtggctggcgtctggctgggtcgttgaaaccgcaggggacatctcgcatctggacgcccctgcattagatgagctgcagcgttaa

SEQ ID NO: 209 - DNA, 753 bp, Escherichia coli
atggctgtaactaagctggttctggttcgtcatggcgaaagtcagtggaacaaagaaaaccgtttcaccggttggtacgacgtggatctgtctgagaaaggcgtaagcgaagcaaaagcagcaggtaagctgctgaaagaggaaggttacagctttgactttgcttacacttctgtgctgaaacgcgctatccataccctgtggaatgtgctggacgaactggatcaggcatggctgcccgttgagaaatcctggaaactgaacgaacgtcactacggtgcgttgcagggtctgaacaaagcggaaactgctgaaaagtatggcgacgagcaggtgaaacagtggcgtcgtggttttgcagtgactccgccggaactgactaaagatgatgagcgttatccgggtcacgatccgcgttacgcgaaactgagcgagaaagaactgccgctgacggaaagcctggcgctgaccattgaccgcgtgatcccttactggaatgaaactattctgccgcgtatgaagagcggtgagcgcgtgatcatcgctgcacacggtaactctttacgtgcgctggtgaaatatcttgataacatgagcgaagaagagattcttgagcttaatatcccgactggcgtgccgctggtgtatgagttcgacgagaatttcaaaccgctgaaacgctattatctgggtaatgctgacgagatcgcagcgaaagcagcggcggttgcaaaccagggtaaagcgaagtaa

SEQ ID NO: 210 - DNA, 1545 bp, Escherichia coli
atgttggtttctaaaaaacctatggtactggtgattctggatggctatggctatcgcgaagaacagcaggataacgccatttttagtgctaaaaccccggtaatggatgcactgtgggccaatcgtccgcataccctaatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccggtgctgactggcgcggtagataaagcgaaaaacgcaggcaaagcggtacacattatgggtctgctctccgcaggcggcgtacacagccacgaagatcacatcatggcgatggtagaactggcagctgaacgcggcgcagaaaaaatctacctgcacgcattccttgacggtcgcgacactccgccgcgcagtgctgaatcctcgctgaaaaaattcgaagaaaaatttgccgcgctgggcaaaggccgcgtagcgtccatcattggtcgttactacgcgatggaccgcgataaccgttgggatcgcgtagaaaaagcttatgacctgctgactctggcgcagggcgagttccaggccgataccgccgttgctggtttgcaggctgcttatgctcgcgacgaaaatgatgaattcgtgaaagcgaccgttatccgtgctgaaggtcagccagacgcggcaatggaagacggcgatgcactgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggccatcaagagcggcaaatacgacaccatcatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgagcagatgcgcgatccggcaacgggtcaggcacacacggcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataa

SEQ ID NO: 211 - DNA, 1299 bp, Escherichia coli
atgtccaaaatcgtaaaaatcatcggtcgtgaaatcatcgactcccgtggtaacccgactgttgaagccgaagtacatctggagggtggtttcgtcggtatggcagctgctccgtcaggtgcttctactggttcccgtgaagctctggaactgcgcgatggcgacaaatcccgtttcctgggtaaaggcgtaaccaaagctgttgctgcggtaaacggcccgatcgctcaggcgctgattggcaaagatgctaaagatcaggctggcattgacaagatcatgatcgacctggacggcaccgaaaacaaatccaaattcggcgcgaacgcaatcctggctgtatctctggctaacgccaaagctgctgcagctgctaaaggtatgccgctgtacgagcacatcgctgaactgaacggtactccgggcaaatactctatgccggttccgatgatgaacatcatcaacggtggtgagcacgctgacaacaacgttgatatccaggaattcatgattcagccggttggcgcgaaaactgtgaaagaagccatccgcatgggttctgaagttttccatcacctggcaaaagttctgaaagcgaaaggcatgaacactgctgttggtgacgaaggtggctatgcgccgaacctgggttccaacgctgaagctctggctgttatcgctgaagctgttaaagctgctggttatgaactgggcaaagacatcactttggcgatggactgcgcagcttctgaattctacaaagatggtaaatacgttctggctggcgaaggcaacaaagcgttcacctctgaagaattcactcacttcctggaagaactgaccaaacagtacccgatcgtttctatcgaagacggtctggacgaatctgactgggacggtttcgcataccagaccaaagttctgggcgacaaaatccagctggttggtgacgacctgttcgtaaccaacaccaagatcctgaaagaaggtatcgaaaaaggtatcgctaactccatcctgatcaaattcaaccagatcggttctctgaccgaaactctggctgcaatcaagatggcgaaagatgctggctacactgcagttatctctcaccgttctggcgaaactgaagacgctaccatcgctgacctggctgttggtactgctgcaggccagatcaaaactggttctatgagccgttctgaccgtgttgctaaatacaaccagctgattcgtatcgaagaagctctgggcgaaaaagcaccgtacaacggtcgtaaagagatcaaaggccaggcataa

SEQ ID NO: 212 - DNA, 1443 bp, Escherichia coli
atgtccagaaggcttcgcagaacaaaaatcgttaccacgttaggcccagcaacagatcgcgataataatcttgaaaaagttatcgcggcgggtgccaacgttgtacgtatgaacttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgtcgtgcctggtgacatcctgctgctggacgatggtcgcgtccagttaaaagtactggaagttcagggcatgaaagtgttcaccgaagtcaccgtcggtggtcccctctccaacaataaaggtatcaacaaacttggcggcggtttgtcggctgaagcgctgaccgaaaaagacaaagcagacattaagactgcggcgttgattggcgtagattacctggctgtctccttcccacgctgtggcgaagatctgaactatgcccgtcgcctggcacgcgatgcaggatgtgatgcgaaaattgttgccaaggttgaacgtgcggaagccgtttgcagccaggatgcaatggatgacatcatcctcgcctctgacgtggtaatggttgcacgtggcgacctcggtgtggaaattggcgacccggaactggtcggcattcagaaagcgttgatccgtcgtgcgcgtcagctaaaccgagcggtaatcacggcgacccagatgatggagtcaatgattactaacccgatgccgacgcgtgcagaagtcatggacgtagcaaacgccgttctggatggtactgacgctgtgatgctgtctgcagaaactgccgctgggcagtatccgtcagaaaccgttgcagccatggcgcgcgtttgcctgggtgcggaaaaaatcccgagcatcaacgtttctaaacaccgtctggacgttcagttcgacaatgtggaagaagctattgccatgtcagcaatgtacgcagctaaccacctgaaaggcgttacggcgatcatcaccatgaccgaatcgggtcgtaccgcgctgatgacctcccgtatcagctctggtctgccaattttcgccatgtcgcgccatgaacgtacgctgaacctgactgctctctatcgtggcgttacgccggtgcactttgatagcgctaatgacggcgtagcagctgccagcgaagcggttaatctgctgcgcgataaaggttacttgatgtctggtgacctggtgattgtcacccagggcgacgtgatgagtaccgtgggttctactaataccacgcgtattttaacggtagagtaa

SEQ ID NO: 213 - DNA, 1413 bp, Escherichia coli
atgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaa

SEQ ID NO: 214 - DNA, 1425 bp, Escherichia coli
atgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaa

SEQ ID NO: 215 - DNA, 2664 bp, Escherichia coli
atgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaa

SEQ ID NO: 216 - DNA, 1893 bp, Escherichia coli
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaa

SEQ ID NO: 217 - DNA, 1284 bp, Escherichia coli
atggctgatacaaaagcaaaactcaccctcaacggggatacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcggcgttctatcacgactcgctggatgttaacaatcctcgtcaccgtgaaattgccgcgttccgcctgctgtcgaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctctacctccaccgtgcgtaccgctggctcttcgggtgcgaacccgtttgcctgtatcgcagcaggtattgcttcactgtggggacctgcgcacggcggtgctaacgaagcggcgctgaaaatgctggaagaaatcagctccgttaaacacattccggaatttgttcgtcgtgcgaaagacaaaaatgattctttccgcctgatgggcttcggtcaccgcgtgtacaaaaattacgacccgcgcgccaccgtaatgcgtgaaacctgccatgaagtgctgaaagagctgggcacgaaggatgacctgctggaagtggctatggagctggaaaacatcgcgctgaacgacccgtactttatcgagaagaaactgtacccgaacgtcgatttctactctggtatcatcctgaaagcgatgggtattccgtcttccatgttcaccgtcattttcgcaatggcacgtaccgttggctggatcgcccactggagcgaaatgcacagtgacggtatgaagattgcccgtccgcgtcagctgtatacaggatatgaaaaacgcgactttaaaagcgatatcaagcgttaa

SEQ ID NO: 218 - DNA, 1170 bp, Escherichia coli
atgagcgacacaacgatcctgcaaaacagtacccatgtcattaaaccgaaaaaatctgtggcactttctggcgttccggcgggcaatacggcgctctgcaccgtgggtaaaagtggcaatgacctgcattaccgcggctacgatattcttgatctggcgaaacattgcgaatttgaagaagtggcgcatctgctgatccacggcaaactgccgacccgtgacgaactcgccgcttacaaaacgaaactgaaagccctgcgcggtttaccggctaacgtgcgtaccgtgctggaagccttaccggcggcgtcgcacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaa

SEQ ID NO: 219 - DNA, 2676 bp, Escherichia coli
atgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaagcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaa

SEQ ID NO: 220 - DNA, 2598 bp, Escherichia coli
gtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttcccccaggcgtcgatgaagccgcctatgtcaaagcaggcttcctggctgctatcgcgaaaggcgaagccaaatcccctctgctgactccggaaaaagccatcgaactgctgggcaccatgcagggtggttacaacattcatccgctgatcgacgcgctggatgatgccaaactggcacctattgctgccaaagcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttactgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggcgatgatattccacatgtgccgaacaaacgcggcggtggtttgtgcctcggcggtaaaattgcacccatcttctttaacacgatggaagacgcgggtgcactgccaatcgaagtcgacgtctctaacctgaacatgggcgacgtgattgacgtttacccgtacaaaggtgaagtgcgtaaccacgaaaccggcgaactgctggcgaccttcgaactgaaaaccgacgtgctgattgatgaagtgcgtgctggtggccgtattccgctgattatcgggcgtggcctgaccaccaaagcgcgtgaagcacttggtctgccgcacagtgatgtgttccgtcaggcgaaagatgtcgctgagagcgatcgcggcttctcgctggcgcaaaaaatggtaggccgtgcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtcattcactcctggctgaaccgtatgctgctgccggataccgtcggtaccggtggtgactcccatacccgtttcccgatcggtatctctttcccggcgggttctggtctggtggcgtttgctgccgcaactggcgtaatgccgcttgatatgccggaatccgttctggtgcgcttcaaaggcaaaatgcagccgggcatcaccctgcgcgatctggtacacgctattccgctgtatgcgatcaaacaaggtctgctgaccgttgagaagaaaggcaagaaaaacatcttctctggccgcatcctggaaattgaaggtctgccggatctgaaagttgagcaggcctttgagctaaccgatgcgtccgccgagcgttctgccgctggttgtaccatcaagctgaacaaagaaccgatcatcgaatacctgaactctaacatcgtcctgctgaagtggatgatcgcggaaggttacggcgatcgtcgtaccctggaacgtcgtattcagggcatggaaaaatggctggcgaatcctgagctgctggaagccgatgcagatgcggaatacgcggcagtgatcgacatcgatctggcggatattaaagagccaatcctgtgtgctccgaacgacccggatgacgcgcgtccgctgtctgcggtacagggtgagaagatcgacgaagtgtttatcggttcctgcatgaccaacatcggtcacttccgtgctgcgggtaaactgctggatgcgcataaaggtcagttgccgacccgcctgtgggtggcaccgccaacccgtatggacgccgcacagttgaccgaagaaggctactacagcgtcttcggtaagagtggtgcgcgtatcgagatccctggctgttccctgtgtatgggtaaccaggcgcgtgtggcggacggtgcaacggtggtttccacctctacccgtaacttcccgaaccgtctgggtactggcgcgaatgtcttcctggcttctgcggaactggcggctgttgcggcgctgattggcaaactgccgacgccggaagagtaccagacctacgtggcgcaggtagataaaacagccgttgatacttaccgttatctgaacttcaaccagctttctcagtacaccgagaaagccgatggggtgattttccagactgcggtttaa

SEQ ID NO: 221 - DNA, 1251 bp, Escherichia coli
atggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaa

SEQ ID NO: 222 - DNA, 918 bp, Escherichia coli
atggaattaatttttttaggtacttcagccggtgtgccaacccgcacgcgcaatgtcacggcaatattgcttaacctgcaacatccgacccagagcggactttggttgtttgactgcggtgaaggcacccagcatcagctactgcataccgcctttaaccctggaaaactggacaagatttttatcagtcaccttcatggcgatcatctttttggtttacccggcttgctgtgcagtcgttctatgtcaggcattatccaacccttaacgatttatggtccgcaaggtatccgtgaatttgtggaaaccgcgctgcggattagcggctcatggaccgattatccgctggaaattgtcgaaattggcgctggcgaaattctcgatgatggcctgcgcaaagtaaccgcttatccgctggaacacccactggaatgttatggctatcgtattgaagaacatgataaaccgggtgcattaaatgcccaggcattaaaagctgctggcgtgccgcctggcccactgtttcaggaattaaaagcgggcaaaacaatcacgctggaagatggaaggcagattaacggcgcagattacttagctgctccagtgccaggtaaagcgctcgctattttcggcgataccggcccctgcgatgccgcacttgacctggctaaaggtgtcgatgtcatggtgcacgaagcgacgctggatataaccatggaagccaaagccaatagtcgcggccatagctctacacgccaggctgcgacactagcccgtgaggctggagtcggcaagctaatcattacccacgtcagctcgcgctatgatgacaaaggttgtcagcacctgttacgtgaatgcaggtcaattttcccggcgactgaactggcgaatgatttcaccgtgtttaacgtttaa

SEQ ID NO: 223 - DNA, 2802 bp, Escherichia coli
atgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataa

SEQ ID NO: 224 - DNA, 1218 bp, Escherichia coli
atgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtag

SEQ ID NO: 225 - DNA, 1167 bp, Escherichia coli
atgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataa

SEQ ID NO: 226 - DNA, 870 bp, Escherichia coli
atgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataa

SEQ ID NO: 227 - DNA, 1305 bp, Escherichia coli
atgaaaacccgtacacaacaaattgaagaattacagaaagagtggactcaaccgcgttgggaaggcattactcgcccatacagtgcggaagatgtggtgaaattacgcggttcagtcaatcctgaatgcacgctggcgcaactgggcgcagcgaaaatgtggcgtctgctgcacggtgagtcgaaaaaaggctacatcaacagcctcggcgcactgactggcggtcaggcgctgcaacaggcgaaagcgggtattgaagcagtctatctgtcgggatggcaggtagcggcggacgctaacctggcggccagcatgtatccggatcagtcgctctatccggcaaactcggtgccagctgtggtggagcggatcaacaacaccttccgtcgtgccgatcagatccaatggtccgcgggcattgagccgggcgatccgcgctatgtcgattacttcctgccgatcgttgccgatgcggaagccggttttggcggtgtcctgaatgcctttgaactgatgaaagcgatgattgaagccggtgcagcggcagttcacttcgaagatcagctggcgtcagtgaagaaatgcggtcacatgggcggcaaagttttagtgccaactcaggaagctattcagaaactggtcgcggcgcgtctggcagctgacgtgacgggcgttccaaccctgctggttgcccgtaccgatgctgatgcggcggatctgatcacctccgattgcgacccgtatgacagcgaatttattaccggcgagcgtaccagtgaaggcttcttccgtactcatgcgggcattgagcaagcgatcagccgtggcctggcgtatgcgccatatgctgacctggtctggtgtgaaacctccacgccggatctggaactggcgcgtcgctttgcacaagctatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactacgttgagaaagtgcagcagccggaatttgccgccgcgaaagatggctataccttcgtatctcaccagcaggaagtgggtacaggttacttcgataaagtgacgactattattcagggcggcacgtcttcagtcaccgcgctgaccggctccactgaagaatcgcagttctaa

SEQ ID NO: 228 - DNA, 1602 bp, Escherichia coli
atgactgaacaggcaacaacaaccgatgaactggctttcacaaggccgtatggcgagcaggagaagcaaattcttactgccgaagcggtagaatttctgactgagctggtgacgcattttacgccacaacgcaataaacttctggcagcgcgcattcagcagcagcaagatattgataacggaacgttgcctgattttatttcggaaacagcttccattcgcgatgctgattggaaaattcgcgggattcctgcggacttagaagaccgccgcgtagagataactggcccggtagagcgcaagatggtgatcaacgcgctcaacgccaatgtgaaagtctttatggccgatttcgaagattcactggcaccagactggaacaaagtgatcgacgggcaaattaacctgcgtgatgcggttaacggcaccatcagttacaccaatgaagcaggcaaaatttaccagctcaagcccaatccagcggttttgatttgtcgggtacgcggtctgcacttgccggaaaaacatgtcacctggcgtggtgaggcaatccccggcagcctgtttgattttgcgctctatttcttccacaactatcaggcactgttggcaaagggcagtggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagctatatcaaaacgttgaaaaactatcccgatcgcgtcctgccagacagacaggcagtgacgatggataaaccattcctgaatgcttactcacgcctgttgattaaaacctgccataaacgcggtgcttttgcgatgggcggcatggcggcgtttattccgagcaaagatgaagagcacaataaccaggtgctcaacaaagtaaaagcggataaatcgctggaagccaataacggtcacgatggcacatggatcgctcacccaggccttgcggacacggcaatggcggtattcaacgacattctcggctcccgtaaaaatcagcttgaagtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaacggctgtgtgccgatttatggcctgatggaagatgcggcgacggctgaaatttcccgtacctcgatctggcagtggatccatcatcaaaaaacgttgagcaatggcaaaccggtgaccaaagccttgttccgccagatgctgggcgaagagatgaaagtcattgccagcgaactgggcgaagaacgtttctcccaggggcgttttgacgatgccgcacgcttgatggaacagatcaccacttccgatgagttaattgatttcctgaccctgccaggctaccgcctgttagcgtaa

SEQ ID NO: 229 - DNA, 1767 bp, Escherichia coli
atgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaa

SEQ ID NO: 230 - DNA, 717 bp, Escherichia coli
atgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaa

SEQ ID NO: 231 - DNA, 390 bp, Escherichia coli
atgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaa

SEQ ID NO: 232 - DNA, 348 bp, Escherichia coli
atggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggctttgcgcctgatgctgcaactggtgattgtcgttgcactggtggtttacgtgatttatggattcgttgtggtgtggggtgtgtga

SEQ ID NO: 233 - DNA, 1449 bp, Escherichia coli
atgaaacttaacgacagtaacttattccgccagcaggcgttgattaacggggaatggctggacgccaacaatggtgaagccatcgacgtcaccaatccggcgaacggcgacaagctgggtagcgtgccgaaaatgggcgcggatgaaacccgcgccgctatcgacgccgccaaccgcgccctgcccgcctggcgcgcgctcaccgccaaagaacgcgccaccattctgcgcaactggttcaatttgatgatggagcatcaggacgatttagcgcgcctgatgaccctcgaacagggtaaaccactggccgaagcgaaaggcgaaatcagctacgccgcctcctttattgagtggtttgccgaagaaggcaaacgcatttatggcgacaccattcctggtcatcaggccgataaacgcctgattgttatcaagcagccgattggcgtcaccgcggctatcacgccgtggaacttcccggcggcgatgattacccgcaaagccggtccggcgctggcagcaggctgcaccatggtgctgaagcccgccagtcagacgccgttctctgcgctggcgctggcggagctggcgatccgcgcgggcgttccggctggggtatttaacgtggtcaccggttcggcgggcgcggtcggtaacgaactgaccagtaacccgctggtgcgcaaactgtcgtttaccggttcgaccgaaattggccgccagttaatggaacagtgcgcgaaagacatcaagaaagtgtcgctggagctgggcggtaacgcgccgtttatcgtctttgacgatgccgacctcgacaaagccgtggaaggcgcgctggcctcgaaattccgcaacgccgggcaaacctgcgtctgcgccaaccgcctgtatgtgcaggacggcgtgtatgaccgttttgccgaaaaattgcagcaggcagtgagcaaactgcacatcggcgacgggctggataacggcgtcaccatcgggccgctgatcgatgaaaaagcggtagcaaaagtggaagagcatattgccgatgcgctggagaaaggcgcgcgcgtggtttgcggcggtaaagcgcacgaacgcggcggcaacttcttccagccgaccattctggtggacgttccggccaacgccaaagtgtcgaaagaagagacgttcggccccctcgccccgctgttccgctttaaagatgaagctgatgtgattgcgcaagccaatgacaccgagtttggccttgccgcctatttctacgcccgtgatttaagccgcgtcttccgcgtgggcgaagcgctggagtacggcatcgtcggcatcaataccggcattatttccaatgaagtggccccgttcggcggcatcaaagcctcgggtctgggtcgtgaaggttcgaagtatggcatcgaagattacttagaaatcaaatatatgtgcatcggtctttaa

SEQ ID NO: 234 - DNA, 1389 bp, Escherichia coli
atgaccattactccggcaactcatgcaatttcgataaatcctgccacgggtgaacaactttctgtgctgccgtgggctggcgctgacgatatcgaaaacgcacttcagctggcggcagcaggctttcgcgactggcgcgagacaaatatagattatcgtgctgaaaaactgcgtgatatcggtaaggctctgcgcgctcgtagcgaagaaatggcgcaaatgatcacccgcgaaatgggcaaaccaatcaaccaggcgcgcgctgaagtggcgaaatcggcgaatttgtgtgactggtatgcagaacatggtccggcaatgctgaaggcggaacctacgctggtggaaaatcagcaggcggttattgagtatcgaccgttggggacgattctggcgattatgccgtggaattttccgttatggcaggtgatgcgtggcgctgttcccatcattcttgcaggtaacggctacttacttaaacatgcgccgaatgtgatgggctgtgcacagctcattgcccaggtgtttaaagatgcgggtatcccacaaggcgtatatggctggctgaatgccgacaacgacggtgtcagtcagatgattaaagactcgcgcattgctgctgtcacggtgaccggaagtgttcgtgcgggagcggctattggcgcacaggctggagcggcactgaaaaaatgcgtactggaactgggcggttcggatccgtttattgtgcttaacgatgccgatctggaactggcggtgaaagcggcggtagccggacgttatcagaataccggacaggtatgtgcagcggcaaaacgctttattatcgaagagggaattgcttcggcatttaccgaacgttttgtggcagctgcggcagccttgaaaatgggcgatccccgtgacgaagagaacgctctcggaccaatggctcgttttgatttacgtgatgagctgcatcatcaggtggagaaaaccctggcgcagggtgcgcgtttgttactgggcggggaaaagatggctggggcaggtaactactatccgccaacggttctggcgaatgttaccccagaaatgaccgcgtttcgggaagaaatgtttggccccgttgcggcaatcaccattgcgaaagatgcagaacatgcactggaactggctaatgatagtgagttcggcctttcagcgaccatttttaccactgacgaaacacaggccagacagatggcggcacgtctggaatgcggtggggtgtttatcaatggttattgtgccagcgacgcgcgagtggcctttggtggcgtgaaaaagagtggctttggtcgtgagctttcccatttcggcttacacgaattctgtaatatccagacggtgtggaaagaccggatctga

SEQ ID NO: 235 - DNA, 1440 bp, Escherichia coli
atgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaa

SEQ ID NO: 236 - DNA, 1647 bp, Escherichia coli
atgtcaaacaaaccctttcattatcaggctccttttccactcaaaaaagatgatactgagtattacctgctaaccagcgaacacgttagcgtatctgaatttgaagggcaggagattttgaaagtcgcacccgaagcgttaactctgttggcgcgccaggcgtttcatgatgcgtcgttcatgctgcgtccggcgcaccaacaacaggtggccgacattctgcgtgacccggaggccagcgaaaatgataaatatgtggcgctgcaattcctgcgtaactccgacatcgcggcgaaaggcgttctgccaacctgtcaggataccggcaccgcgattattgttggtaaaaaagggcagcgtgtatggaccggtggtggtgatgaagcggcgctggcgcgcggtgtctataacacttatatcgaagataatctgcgctactcgcaaaacgcgccgctggatatgtataaagaagtgaataccggcaccaatctgccagcgcagatcgatctttatgccgttgatggcgacgaatacaaattcctctgtatcgccaaaggtggtggttcggcaaacaagacgtatctctatcaggaaaccaaagcgttactgacgccggggaaactgaaaaattacctggttgagaagatgcgcacgctgggtacggcggcctgtcctccgtatcatattgcgttcgttattggtggaacttctgcagaaacgaaccttaaaacggtgaaactggcttccgcgaaatactatgatgaactgccaacggaagggaatgagcacggtcaggcgttccgcgatgtggaactggaaaaagaattgctgatcgaagcgcaaaatcttggtctgggtgcgcagtttggtggtaaatacttcgctcacgacatccgcgtgattcgcctgccacgtcacggcgcatcctgcccggtcggtatgggcgtctcctgctctgctgaccgtaatatcaaagcgaagatcaaccgtcaggggatctggatcgaaaaactggaacataatccaggcaaatatatcccggaagagctgcgcaaagcgggagaaggcgaagcggtgcgcgttgaccttaaccgtccgatgaaagagatcctcgcacagttgtcgcagtatcccgtttctacacgcttatcgcttaacggcacgattatcgtcggtcgtgatattgctcacgccaaactgaaagagcggatggataacggtgaagggctgccgcagtacatcaaagatcatccgatttactacgcgggtccggccaaaacgccggaaggttatgcctccggttctcttggcccaacgaccgccggacggatggattcttatgtcgatcaactgcaagcgcagggcggaagtatgatcatgctggcgaaaggcaaccgcagccagcaggtgacggatgcctgtaaaaaacacggcggcttctaccttggcagtatcggtggtccggccgctgtattggcgcagggaagtattaagagcctggaatgtgttgaatatccggaactgggaatggaagccatctggaaaattgaagtggaagatttcccggcgtttatccttgtggatgataaaggaaatgacttcttccagcagatacaactcacacaatgcacccgctgtgtgaaataa

SEQ ID NO: 237 - DNA, 1647 bp, Escherichia coli
atgtcaaacaaaccctttatctaccaggcacctttcccgatggggaaagacaataccgaatactatctactcacttccgattacgttagcgttgccgacttcgacggcgaaaccatcctgaaagtggaaccagaagccctgaccctgctggcgcagcaagcctttcacgacgcttcttttatgctccgcccggcacaccagaaacaggttgcggctattcttcacgatccagaagccagcgaaaacgacaagtacgtggcgctgcaattcttaagaaactccgaaatcgccgccaaaggcgtgctgccgacctgccaggataccggcaccgcgatcatcgtcggtaaaaaaggccagcgcgtgtggaccggcggcggtgatgaagaaacgctgtcgaaaggcgtctataacacctatatcgaagataacctgcgctattcacagaatgcggcgctggacatgtacaaagaggtcaacaccggcactaacctgcctgcgcaaatcgacctgtacgcggtagatggcgatgagtacaaattcctttgcgttgcgaaaggcggcggctctgccaacaaaacgtatctctaccaggaaaccaaagccctgctgactcccggcaaactgaaaaacttcctcgtcgagaaaatgcgtaccctcggtactgcagcctgcccgccgtaccatatcgcgtttgtgattggcggtacgtctgcggaaaccaacctgaaaaccgtcaagttagcaagcgctcactattacgatgaactgccgacggaagggaacgaacatggtcaggcgttccgcgatgtccagctggaacaggaactgctggaagaggcccagaaactcggtcttggcgcgcagtttggcggtaaatacttcgcgcacgacattcgcgttatccgtctgccacgtcacggcgcatcctgcccggtcggcatgggcgtctcctgctccgctgaccgtaacattaaagcgaaaatcaaccgcgaaggtatctggatcgaaaaactggaacacaacccaggccagtacattccacaagaactgcgccaggccggtgaaggcgaagcggtgaaagttgaccttaaccgcccgatgaaagagatcctcgcccagctttcgcaatacccggtatccactcgtttgtcgctcaccggcaccattatcgtgggccgagatattgcacacgccaagctgaaagagctgattgacgccggtaaagaacttccgcagtacatcaaagatcacccgatctactacgcgggtccggcgaaaacccctgccggttatccatcaggttcacttggcccaaccaccgcaggccgtatggactcctacgtggatctgctgcaatcccacggcggcagcatgatcatgctggcgaaaggtaaccgcagtcagcaggttaccgacgcgtgtcataaacacggcggcttctacctcggtagcatcggcggtccggcggcggtactggcgcagcagagcatcaagcatctggagtgcgtcgcttatccggagctgggtatggaagctatctggaaaatcgaagtagaagatttcccggcgtttatcctggtcgatgacaaaggtaacgacttcttccagcaaatcgtcaacaaacagtgcgcgaactgcactaagtaa

SEQ ID NO: 238 - DNA, 1404 bp, Escherichia coli
atgaatacagtacgcagcgaaaaagattcgatgggggcgattgatgtcccggcagataagctgtggggcgcacaaactcaacgctcgctggagcatttccgcatttcgacggagaaaatgcccacctcactgattcatgcgctggcgctaaccaagcgtgcagcggcaaaagttaatgaagatttaggcttgttgtctgaagagaaagcgagcgccattcgtcaggcggcggatgaagtactggcaggacagcatgacgacgaattcccgctggctatctggcagaccggctccggcacgcaaagtaacatgaacatgaacgaagtgctggctaaccgggccagtgaattactcggcggtgtgcgcgggatggaacgtaaagttcaccctaacgacgacgtgaacaaaagccaaagttccaacgatgtctttccgacggcgatgcacgttgcggcgctgctggcgctgcgcaagcaactcattcctcagcttaaaaccctgacacagacactgaatgagaaatcccgtgcttttgccgatatcgtcaaaattggtcgtactcacttgcaggatgccacgccgttaacgctggggcaggagatttccggctgggtagcgatgctcgagcataatctcaaacatatcgaatacagcctgcctcacgtagcggaactggctcttggcggtacagcggtgggtactggactaaatacccatccggagtatgcgcgtcgcgtagcagatgaactggcagtcattacctgtgcaccgtttgttaccgcgccgaacaaatttgaagcgctggcgacctgtgatgccctggttcaggcgcacggcgcgttgaaagggttggctgcgtcactgatgaaaatcgccaatgatgtccgctggctggcctctggcccgcgctgcggaattggtgaaatctcaatcccggaaaatgagccgggcagctcaatcatgccggggaaagtgaacccaacacagtgtgaggcattaaccatgctctgctgtcaggtgatggggaacgacgtggcgatcaacatggggggcgcttccggtaactttgaactgaacgtcttccgtccaatggtgatccacaatttcctgcaatcggtgcgcttgctggcagatggcatggaaagttttaacaaacactgcgcagtgggtattgaaccgaatcgtgagcgaatcaatcaattactcaatgaatcgctgatgctggtgactgcgcttaacacccacattggttatgacaaagccgccgagatcgccaaaaaagcgcataaagaagggctgaccttaaaagctgcggcccttgcgctggggtatcttagcgaagccgagtttgacagctgggtacggccagaacagatggtcggcagtatgaaagccgggcgttaa

SEQ ID NO: 239 - DNA, 1191 bp, Escherichia coli
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 240 - DNA, 939 bp, Escherichia coli
atgaaagtcgcagtcctcggcgctgctggcggtattggccaggcgcttgcactactgttaaaaacccaactgccttcaggttcagaactctctctgtatgatatcgctccagtgactcccggtgtggctgtcgatctgagccatatccctactgctgtgaaaatcaaaggtttttctggtgaagatgcgactccggcgctggaaggcgcagatgtcgttcttatctctgcaggcgtagcgcgtaaaccgggtatggatcgttccgacctgtttaacgttaacgccggcatcgtgaaaaacctggtacagcaagttgcgaaaacctgcccgaaagcgtgcattggtattatcactaacccggttaacaccacagttgcaattgctgctgaagtgctgaaaaaagccggtgtttatgacaaaaacaaactgttcggcgttaccacgctggatatcattcgttccaacacctttgttgcggaactgaaaggcaaacagccaggcgaagttgaagtgccggttattggcggtcactctggtgttaccattctgccgctgctgtcacaggttcctggcgttagttttaccgagcaggaagtggctgatctgaccaaacgcatccagaacgcgggtactgaagtggttgaagcgaaggccggtggcgggtctgcaaccctgtctatgggccaggcagctgcacgttttggtctgtctctggttcgtgcactgcagggcgaacaaggcgttgtcgaatgtgcctacgttgaaggcgacggtcagtacgcccgtttcttctctcaaccgctgctgctgggtaaaaacggcgtggaagagcgtaaatctatcggtaccctgagcgcatttgaacagaacgcgctggaaggtatgctggatacgctgaagaaagatatcgccctgggcgaagagttcgttaataagtaa

SEQ ID NO: 241 - DNA, 1071 bp, Escherichia coli
atgcaaaaagacgcgctgaataacgtacatattaccgacgaacaggttttaatgactccggaacaactgaaggccgcttttccattgagcctgcaacaagaagcccagattgctgactcgcgtaaaagcatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcaccgttttgttggcattaaccaggcagggcaggttgcgttgctacaaactcaggggaatccggacggccatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 242 - DNA, 1053 bp, Escherichia coli
atgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaa

SEQ ID NO: 243 - DNA, 1047 bp, Escherichia coli
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgaccggtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctga

SEQ ID NO: 244 - DNA, 1089 bp, Escherichia coli
atggagaggattgtcgttactctcggggaacgtagttacccaattaccatcgcatctggtttgtttaatgaaccagcttcattcttaccgctgaaatcgggcgagcaggtcatgttggtcaccaacgaaaccctggctcctctgtatctcgataaggtccgcggcgtacttgaacaggcgggtgttaacgtcgatagcgttatcctccctgacggcgagcagtataaaagcctggctgtactcgataccgtctttacggcgttgttacaaaaaccgcatggtcgcgatactacgctggtggcgcttggcggcggcgtagtgggcgatctgaccggcttcgcggcggcgagttatcagcgcggtgtccgtttcattcaagtcccgacgacgttactgtcgcaggtcgattcctccgttggcggcaaaactgcggtcaaccatcccctcggtaaaaacatgattggcgcgttctaccaacctgcttcagtggtggtggatctcgactgtctgaaaacgcttcccccgcgtgagttagcgtcggggctggcagaagtcatcaaatacggcattattcttgacggtgcgttttttaactggctggaagagaatctggatgcgttgttgcgtctggacggtccggcaatggcgtactgtattcgccgttgttgtgaactgaaggcagaagttgtcgccgccgacgagcgcgaaaccgggttacgtgctttactgaatctgggacacacctttggtcatgccattgaagctgaaatggggtatggcaattggttacatggtgaagcggtcgctgcgggtatggtgatggcggcgcggacgtcggaacgtctcgggcagtttagttctgccgaaacgcagcgtattataaccctgctcaagcgggctgggttaccggtcaatgggccgcgcgaaatgtccgcgcaggcgtatttaccgcatatgctgcgtgacaagaaagtccttgcgggagagatgcgcttaattcttccgttggcaattggtaagagtgaagttcgcagcggcgtttcgcacgagcttgttcttaacgccattgccgattgtcaatcagcgtaa

SEQ ID NO: 245 - DNA, 759 bp, Escherichia coli
atgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgacctctccaatgtggagtctgtcatggcggcagcaaaaattctccgtgagaccatgccagaaaaaccgctgctgtttaccttccgcagtgccaaagaaggcggcgagcaggcgatttccaccgaggcttatattgcactcaatcgtgcagccatcgacagcggcctggttgatatgatcgatctggagttatttaccggtgatgatcaggttaaagaaaccgtcgcctacgcccacgcgcatgatgtgaaagtagtcatgtccaaccatgacttccataaaacgccggaagccgaagaaatcattgcccgtctgcgcaaaatgcaatccttcgacgccgatattcctaagattgcgctgatgccgcaaagtaccagcgatgtgctgacgttgcttgccgcgaccctggagatgcaggagcagtatgccgatcgtccaattatcacgatgtcgatggcaaaaactggcgtaatttctcgtctggctggtgaagtatttggctcggcggcaacttttggtgcggtaaaaaaagcgtctgcgccagggcaaatctcggtaaatgatttgcgcacggtattaactattttacaccaggcataa

SEQ ID NO: 246 - DNA, 867 bp, Escherichia coli
atggatgttaccgcaaaatacgaattgattgggttgatggcctatcctatccgccacagtttatcgcccgaaatgcagaataaagccttagaaaaagcgggattgccatttacctatatggccttcgaagtggataacgatagctttcctggagcaattgaaggattaaaagccctcaaaatgcgcggaactggtgtatcgatgccgaacaaacaactggcgtgtgaatatgttgatgaattaacaccagctgccaaactggtgggggccatcaacaccatcgttaatgatgatggctatctgcgtggctataacaccgacggcacgggccatattcgcgccattaaagagagcggttttgatatcaaaggcaaaacgatggtgctgttaggggccggtggtgcctcaacggcaattggcgcgcagggggcaattgaaggtttaaaagaaattaaactctttaaccgtcgggatgagttcttcgataaagccctcgccttcgcgcagcgggttaatgaaaacaccgattgtgtcgtcacggtcaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacattatggactggcaaagatttccctctggaatatgttaaacaggtcatggggttcggtgcctga

SEQ ID NO: 247 - DNA, 819 bp, Escherichia coli
atggaaacctatgctgtttttggtaatccgatagcccacagcaaatcgccattcattcatcagcaatttgctcagcaactgaatattgaacatccctatgggcgcgtgttggcacccatcaatgatttcatcaacacactgaacgctttctttagtgctggtggtaaaggtgcgaatgtgacggtgccttttaaagaagaggcttttgccagagcggatgagcttactgaacgggcagcgttggctggtgctgttaataccctcatgcggttagaagatggacgcctgctgggtgacaataccgatggtgtaggcttgttaagcgatctggaacgtctgtcttttatccgccctggtttacgtattctgcttatcggcgctggtggagcatctcgcggcgtactactgccactcctttccctggactgtgcggtgacaataactaatcggacggtatcccgcgcggaagagttggctaaattgtttgcgcacactggcagtattcaggcgttgagtatggacgaactggaaggtcatgagtttgatctcattattaatgcaacatccagtggcatcagtggtgatattccggcgatcccgtcatcgctcattcatccaggcatttattgctatgacatgttctatcagaaaggaaaaactccttttctggcatggtgtgagcagcgaggctcaaagcgtaatgctgatggtttaggaatgctggtggcacaggcggctcatgcctttcttctctggcacggtgttctgcctgacgtagaaccagttataaagcaattgcaggaggaattgtccgcgtga

SEQ ID NO: 248 - DNA, 522 bp, Escherichia coli
atggcagagaaacgcaatatctttctggttgggcctatgggtgccggaaaaagcactattgggcgccagttagctcaacaactcaatatggaattttacgattccgatcaagagattgagaaacgaaccggagctgatgtgggctgggttttcgatttagaaggcgaagaaggcttccgcgatcgcgaagaaaaggtcatcaatgagttgaccgagaaacagggtattgtgctggctactggcggcggctctgtgaaatcccgtgaaacgcgtaaccgtctttccgctcgtggcgttgtcgtttatcttgaaacgaccatcgaaaagcaacttgcacgcacgcagcgtgataaaaaacgcccgttgctgcacgttgaaacaccgccgcgtgaagttctggaagcgttggccaatgaacgcaatccgctgtatgaagagattgccgacgtgaccattcgtactgatgatcaaagcgctaaagtggttgcaaaccagattattcacatgctggaaagcaactaa

SEQ ID NO: 249 - DNA, 525 bp, Escherichia coli
atgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttga

SEQ ID NO: 250 - DNA, 1284 bp, Escherichia coli
atggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgcgctgcgcctgggcggggcgaagatcacttacctggaacaagaaaattatccgccgttgcgtttacagggcggctttactggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcctgatgcggcgatgaccattgccacggcggcgttatttgcaaaaggcaccaccacgctgcgcaatatctataactggcgtgttaaagagaccgatcgcctgtttgcgatggcaacagaactgcgtaaagtcggcgcggaagtggaagaggggcacgattacattcgtatcactcctccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctga

SEQ ID NO: 251 - DNA, 1086 bp, Escherichia coli
atggctggaaacacaattggacaactctttcgcgtaaccaccttcggcgaatcgcacgggctggcgctcggctgcatcgtcgatggtgttccgccaggcattccgctgacggaagcggacctgcaacatgacctcgaccgtcgtcgccctgggacatcgcgctataccacccagcgccgcgagccggatcaggtcaaaattctctccggtgtttttgaaggcgttactaccggcaccagcattggcttgttgatcgaaaacactgaccagcgctctcaggattacagtgcgattaaggacgttttccgtccaggccatgccgattacacctacgaacaaaaatacggtctgcgcgattatcgcggcggtggacgttcttccgcccgcgaaaccgccatgcgcgtggcggcaggagctattgccaaaaaatatctcgccgagaaatttggtattgaaatccgtggctgcctgacccagatgggcgacattccgctggatatcaaagactggtcgcaggtcgagcaaaatccgtttttttgcccggaccccgacaaaatcgacgcgttagacgagttgatgcgtgcgctgaaaaaagagggcgactccatcggcgctaaagtcaccgttgttgccagtggcgttcctgccggacttggcgagccggtctttgaccgcctggatgctgacatcgcccatgcgctgatgagcatcaacgcggtgaaaggcgtggaaattggcgacggctttgacgtggtggcgctgcgcggcagccagaaccgcgatgaaatcaccaaagacggtttccagagcaaccatgcgggcggcattctcggcggtatcagcagcgggcagcaaatcattgcccatatggcgctgaaaccgacctccagcattaccgtgccgggtcgtaccattaaccgctttggcgaagaagttgagatgatcaccaaaggccgtcacgatccctgtgtcgggatccgcgcagtgccgatcgcagaagcgatgctggcgatcgttttaatggatcacctgttacggcaacgggcgcaaaatgccgatgtgaagactgatattccacgctggtaa

SEQ ID NO: 252 - DNA, 564 bp, Escherichia coli
atgatcctgcttatagataactacgattcttttacctggaacctctaccagtacttttgtgaactgggggcggatgtgctggttaagcgcaacgatgcgttgacgctggcggatatcgacgcccttaaaccacaaaaaattgtcatctcacctggcccctgtacgccagatgaagccgggatctcccttgacgttattcgccactatgccgggcgcttgccgattcttggcgtctgcctcggtcatcaggcaatggcgcaggcatttggcggtaaagttgtgcgcgccgcaaaggtcatgcacggcaaaacctcgccgattacacataacggtgagggcgtatttcgggggctggcaaatccacttaccgtgacacgctaccattcgctggtggtggaacctgactcattaccagcgtgctttgacgtgacggcctggagcgaaacccgagagattatggggattcgccatcgccagtgggatctggaaggtgtgcagttccatccagaaagtattcttagcgaacaaggacatcaactgctggctaatttcctgcatcgctga

SEQ ID NO: 253 - DNA, 1362 bp, Escherichia coli
atgaagacgttatctcccgctgtgattactttactctggcgtcaggacgccgctgaattttatttctcccgcttaagccacctgccgtgggcgatgcttttacactccggctatgccgatcatccgtatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccaacgcataacgaagatttgccatttcagggcggcgcactggggttgtttggctacgatctgggccgccgttttgagtcactgccagaaattgcggaacaagatatcgttctgccggatatggcagtgggtatctacgattgggcgctcattgtcgaccaccagcgtcatacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccaacgttttcatgcgacctattctggcgatgaatggcaggcattccttcagcttaatcaggccaaccgcgcgccatttagcgcttttttacgtcttgaacagggtgcaattttaagcctttcgccagagcggtttattctttgtgataatagtgaaatccagacccgcccgattaaaggcacgctaccacgcctgcccgatcctcaggaagatagcaaacaagcagtaaaactggcgaactcagcgaaagatcgtgccgaaaatctgatgattgtcgatttaatgcgtaatgatatcggtcgtgttgccgtagcaggttcggtaaaagtaccagagctgttcgtggtggaacccttccctgccgtgcatcatctggtcagcaccataacggcgcaactaccagaacagttacacgccagcgatctgctgcgcgcagcttttcctggtggctcaataaccggggctccgaaagtacgggctatggaaattatcgacgaactggaaccgcagcgacgcaatgcctggtgcggcagcattggctatttgagcttttgcggcaacatggataccagtattactatccgcacgctgactgccattaacggacaaattttctgctctgcgggcggtggaattgtcgccgatagccaggaagaagcggaatatcaggaaacttttgataaagttaatcgtatcctgaagcaactggagaagtaa

SEQ ID NO: 254 - DNA, 1122 bp, Escherichia coli
atggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacactttgtccgtcactgcgtccggtggttatcgtcggcggtggcggtcagatgggacgcctgttcgagaagatgctgaccctctcgggttatcaggtgcggattctggagcaacatgactgggatcgagcggctgatattgttgccgatgccggaatggtgattgttagtgtgccaatccacgttactgagcaagttattggcaaattaccgcctttaccgaaagattgtattctggtcgatctggcatcagtgaaaaatgggccattacaggccatgctggtggcgcatgatggtccggtgctggggctacacccgatgttcggtccggacagcggtagcctggcaaagcaagttgtggtctggtgtgatggacgtaaaccggaagcataccaatggtttctggagcaaattcaggtctggggcgctcggctgcatcgtattagcgccgtcgagcacgatcagaatatggcgtttattcaggcactgcgccactttgctacttttgcttacgggctgcacctggcagaagaaaatgttcagcttgagcaacttctggcgctctcttcgccgatttaccgccttgagctggcgatggtcgggcgactgtttgctcaggatccgcagctttatgccgacatcattatgtcgtcagagcgtaatctggcgttaatcaaacgttactataagcgtttcggcgaggcgattgagttgctggagcagggcgataagcaggcgtttattgacagtttccgcaaggtggagcactggttcggcgattacgcacagcgttttcagagtgaaagccgcgtgttattgcgtcaggcgaatgacaatcgccagtaa

SEQ ID NO: 255 - DNA, 1161 bp, Escherichia coli
atgacatcggaaaacccgttactggcgctgcgagagaaaatcagcgcgctggatgaaaaattattagcgttactggcagaacggcgcgaactggccgtcgaggtgggaaaagccaaactgctctcgcatcgcccggtacgtgatattgatcgtgaacgcgatttgctggaaagattaattacgctcggtaaagcgcaccatctggacgcccattacattactcgcctgttccagctcatcattgaagattccgtattaactcagcaggctttgctccaacaacatctcaataaaattaatccgcactcagcacgcatcgcttttctcggccccaaaggttcttattcccatcttgcggcgcgccagtatgctgcccgtcactttgagcaattcattgaaagtggctgcgccaaatttgccgatatttttaatcaggtggaaaccggccaggccgactatgccgtcgtaccgattgaaaataccagctccggtgccataaacgacgtttacgatctgctgcaacataccagcttgtcgattgttggcgagatgacgttaactatcgaccattgtttgttggtctccggcactactgatttatccaccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttgggaagcgaagctggcggcactttgtacggtttgcaggtactggagcgtattgaagcaaatcagcgacaaaacttcacccgatttgtggtgttggcgcgtaaagccattaacgtgtctgatcaggttccggcgaaaaccacgttgttaatggcgaccgggcaacaagccggtgcgctggttgaagcgttgctggtactgcgcaaccacaatctgattatgacccgtctggaatcacgcccgattcacggtaatccatgggaagagatgttctatctggatattcaggccaatcttgaatcagcggaaatgcaaaaagcattgaaagagttaggggaaatcacccgttcaatgaaggtattgggctgttacccaagtgagaacgtagtgcctgttgatccaacctga

SEQ ID NO: 256 - DNA, 1194 bp, Escherichia coli
gtgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaa

SEQ ID NO: 257 - DNA, 1191 bp, Escherichia coli; identical to SEQ ID NO: 239

SEQ ID NO: 258 - DNA, 873 bp, Escherichia coli
atggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggtgtctggctgatgcgcgctgccggatgtgtggtgaatgattatgctgaccgcaagtttgatggtcatgttaagcgcacggcgaaccgaccacttcccagcggcgcggtaacagagaaagaggcgcgcgcgctgtttgtcgtgctggtactgatttcgtttttactggtgctgacgctgaatacgatgaccattctgttgtcgattgccgcgctagcgctggcgtgggtgtacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccacggcaatcctgttcggccaatacgataaattgattattggtattttgcagattggcgtactggcactgatggcgatcatcggtgagttaaatggcttaggctggggatattactggtcaattctggtggctggcgcgctgtttgtttatcaacaaaaactgattgccaaccgcgagcgtgaagcctgctttaaagcatttatgaataataactatgttggtctggtactatttttagggctggcaatgagttactggcatttctga

SEQ ID NO: 259 - DNA, 498 bp, Escherichia coli
atgtcacaccccgcgttaacgcaactgcgtgcgctgcgctattgtaaagagatccctgccctggatccgcaactgctcgactggctgttgctggaggattccatgacaaaacgttttgaacagcagggaaaaacggtaagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccgggctgtgggggcgacgttcccgcctgcgattaagcggtaaaccgctgttgctaacagaactgtttttaccggcgtcaccgttgtactaa

SEQ ID NO: 260 - DNA, 570 bp, Escherichia coli
atgaaacgactcattgtaggcatcagcggtgccagcggcgcgatttatggcgtgcgcttattacaggttctgcgcgatgtcacagatatcgaaacgcatctggtgatgagccaggcagcgcgccagaccttatccctcgaaacggatttttctctgcgcgaagtgcaggcattagccgatgtcacgcacgatgcgcgcgatattgccgccagcatctcttccggttctttccagacgctggggatggtgattttaccctgttcaatcaaaaccctttccggcattgtccatagctatactgatggcttactgacccgtgcggcagatgtggtgctgaaagagcgtcgcccgttggtgctctgcgtgcgtgaaacaccattgcacttaggccatctgcgtttaatgactcaggcggcagaaatcggtgcggtgattatgcctcccgttccggcgttttatcatcgcccgcaatcccttgatgatgtgataaatcagacggttaatcgtgttcttgaccagtttgcgataacccttcctgaagatctctttgcccgctggcagggcgcataa

SEQ ID NO: 261 - DNA, 1494 bp, Escherichia coli
atggacgccatgaaatataacgatttacgcgacttcttgacgctgcttgaacagcagggtgagctaaaacgtatcacgctcccggtggatccgcatctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcggctgcgtggtgcgccctgccaacaaaaaatcgtctctggcgatgacgtcgatctcaatcgcattcccattatgacctgctggccggaagatgccgcgccgctgattacctgggggctgacagtgacgcgcggcccacataaagagcggcagaatctgggcatttatcgccagcagctgattggtaaaaacaaactgattatgcgctggctgtcgcatcgcggcggcgcgctggattatcaggagtggtgtgcggcgcatccgggcgaacgtttcccggtttctgtggcgctgggtgccgatcccgccacgattctcggtgcagtcactcccgttccggatacgctttcagagtatgcgtttgccggattgctacgtggcaccaagaccgaagtggtgaagtgtatctccaatgatcttgaagtgcccgccagtgcggagattgtgctggaagggtatatcgaacaaggcgaaactgcgccggaagggccgtatggcgaccacaccggttactataatgaagtcgatagtttcccggtatttaccgtgacgcatattacccagcgtgaagatgcgatttaccattccacctataccgggcgtccgccagatgagcccgcggtgctgggtgtcgcactgaacgaagtgtttgtgccgattctgcaaaaacagttcccggaaattgtcgatttttacctgccgccggaaggctgctcttatcgcctggcggtagtgacaatcaaaaaacagtacgccggacacgcgaagcgcgtcatgatgggcgtctggtcgttcttacgccagtttatgtacactaaatttgtgatcgtttgcgatgatgacgttaacgcacgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggggaaacccagcgtgaatggggacgtcccatcaaaaaagatccagatgttgtcgcgcatattgacgccatctgggatgaactggctatttttaacaacggtaaaagcgcctga

SEQ ID NO: 262 - DNA, 1641 bp, Escherichia coli
atgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacttttaggtgagcgactacgactggccctgcaagaactggggccggtttggatcaagttcgggcaaatgttatcaacccgccgcgatctttttccaccgcatattgccgatcagctggcgttattgcaggacaaagttgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagtcatccgcccggatattttgccggttattaaagcggatctgaaacttatctaccgtctggctcgctgggtgccgcgtttgctgccggatggtcgccgtctgcgcccaaccgaagtggtgcgcgagtacgaaaagacattgattgatgaactgaatttgctgcgggaatctgccaacgccattcagcttcggcgcaattttgaagacagcccgatgctctacatcccggaagtttaccctgactattgtagtgaagggatgatggtgatggagcgcatttacggcattccggtgtctgatgttgcggcgctggagaaaaacggcactaacatgaaattgctggcggaacgcggcgtgcaggtgttcttcactcaggtctttcgcgacagctttttccatgccgatatgcaccctggcaacatcttcgtaagctatgaacacccggaaaacccgaaatatatcggcattgattgcgggattgttggctcgctaaacaaagaagataaacgctatctggcagaaaactttatcgccttctttaatcgcgactatcgcaaagtggcagagctacacgtcgattctggctgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaattggtttacgacagtttgcgccagggcaagtatttacagcacagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctga

SEQ ID NO: 263 - DNA, 723 bp, Escherichia coli
atgaatgccgaaaaatcgccggtaaaccataacgtagaccacgaagagatcgctaaatttgaagccgtcgcctcccgctggtgggatctggaaggtgagttcaaaccgctgcaccgcattaacccgctgcgtctgggctatattgccgagcgtgctggcggtttatttggcaaaaaggtgctcgatgtcggttgtggcggcggcattctggccgagagtatggcgcgcgaaggcgcgacggtgaccggtctggatatgggctttgagccattgcaggtggcaaaactgcacgcactggaaagcggcattcaggtggattacgtgcaggaaaccgtggaagagcacgcggcaaaacatgccgggcagtatgatgtggtgacctgcatggagatgctggagcacgtccccgatccgcagtcagtggtcagagcctgtgcgcaactggtgaaaccaggcggcgatgtctttttctcgacacttaaccgcaacggcaagtcatggctgatggcggtggttggtgcggaatatattttgcgcatggtgcccaaaggcacgcatgatgtgaagaagtttattaaaccggcagaattgctgggctgggtggatcagaccagtttaaaagagcggcatatcactgggctgcattacaacccgatcactaatacttttaaactcggccccggcgtggatgtgaactatatgctgcacacgcagaataagtga

SEQ ID NO: 264 - DNA, 1179 bp, Escherichia coli
atgagcgtaatcatcgtcggtggcggcatggcgggcgcgacgctggcgctggctatttcccggttaagtcacggggcgctgccggtacatttgattgaagcgactgcgccagagtcacatgctcatccgggctttgatggacgagcgatagcgctggcggcgggtacctgtcagcaactggcgcgcatcggcgtctggcaatctctggcggattgcgcaactgccatcaccaccgtgcatgtcagcgatcgtggtcacgctggatttgtcaccctcgccgcagaagattaccaactggcggcgctgggacaggttgtcgaattgcacaatgtcgggcaacggctgtttgcattgctgcgtaaagcacctggcgtaacgctgcattgccctgatcgcgtggctaacgttgcccgtactcagagtcacgttgaagtgacgctggagagtggcgagacgctgacgggccgcgtgctggtagcagctgatggcacccattcagcgttagccaccgcgtgcggcgttgactggcagcaggagccttacgaacaactggccgtgattgccaacgttgctacttccgttgcgcatgaagggcgcgcttttgaacgctttacgcaacatggcccgctggcgatgttgccgatgtctgacggacgctgttcgctggtctggtgtcatccactggaacggcgcgaagaggtgttgtcgtggagtgacgagaagttttgccgtgaactccagtcggcctttggctggcgacttgggaaaattacccacgctggtaaacgcagtgcttatccgctggcgttaacccacgccgccagatctattacccatcgtaccgtgctggtgggcaatgcggcgcaaactctgcacccgattgccgggcaagggtttaacctcggtatgcgagatgtgatgagtcttgcggaaaccctgactcaggcgcaggagcgcggagaagacatgggggattacggcgtattgtgccgttatcagcagcgtcgacagagcgatcgcgaagcaaccattggcgtcacggacagccttgtacatctttttgccaaccgttgggcaccgctggttgtcgggcgcaacatcgggctgatgacgatggaattattcaccccggcacgcgatgtgctggcgcagcgcaccctcggttgggtggcgcgttga

SEQ ID NO: 265 - DNA, 756 bp, Escherichia coli
atggtggataagtcacaagaaacgacgcactttggttttcagaccgtcgcgaaggaacaaaaagcggatatggtcgcccacgttttccattccgtggcatcaaaatacgatgtcatgaatgatttgatgtcatttggtattcatcgtttgtggaagcgattcacgattgattgcagcggcgtacgccgtgggcagaccgtgctggatctggctggtggcaccggcgacctgacagcgaaattctcccgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtgcttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaagccatgatgcaggatgccggattcgaaagtgtcgactactacaatctgacggcaggggttgtggcgctgcatcgtggttataagttctga

SEQ ID NO: 266 - DNA, 1176 bp, Escherichia coli
atgacaaatcaaccaacggaaattgccattgtcggcggaggaatggtcggcggcgcactggcgctggggctggcacagcacggatttgcggtaacggtgatcgagcacgcagaaccagcgccgtttgtcgctgatagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgctgcttggctatatggtggaaaacactgtcctgcaacaggcgttgtggcaggcgctggaagcgcatccgaaagtaacgttacgtgtgccaggctcgctgattgcgctgcatcgccatgatgatcttcaggagctggagctgaaaggcggtgaagtgattcgcgcgaagctggtgattggtgccgacggcgcaaattcgcaggtgcggcagatggcgggaattggcgttcatgcatggcagtatgcgcagtcgtgcatgttgattagcgtccagtgcgagaacgatcccggcgacagcacctggcagcaatttactccggacggaccgcgtgcgtttctgccgttgtttgataactgggcatcgctggtgtggtatgactctccggcgcgtattcgccagttgcagaatatgaatatggcacagctccaggcggaaatcgcgaagcatttcccgtcgcgtctgggttacgttacaccgcttgccgctggtgcgtttccgctgacgcgtcgccatgcgttgcagtacgtgcagccagggcttgcgctggtgggcgatgccgcgcataccatccatccgctggcggggcagggagtgaatcttggttatcgtgatgtcgatgccctgattgatgttctggtcaacgcccgcagctacggcgaagcgtgggccagttatcctgtcctcaagcgttaccagatgcggcgcatggcggataacttcattatgcaaagcggtatggatctgttttatgccggattcagcaataatctgccaccactgcgttttatgcgtaatctcgggttaatggcggcggagcgtgctggcgtgttgaaacgtcaggcgctgaaatatgcgttagggttgtag

SEQ ID NO: 267 - DNA, 1596 bp, Escherichia coli
atggctgacattctgctgctcgataatatcgactcttttacgtacaacctggcagatcagttgcgcagcaatgggcataacgtggtgatttaccgcaaccatattccggcgcaaaccttaattgaacgcctggcgaccatgagcaatccggtgctgatgctttctcctggccccggtgtgccgagcgaagccggttgtatgccggaactcctcacccgcttgcgtggcaagctgcccattattggcatttgcctcggacatcaggcgattgtcgaagcttacgggggctatgtcggtcaggcgggcgaaattctccacggtaaagcctccagcattgaacatgacggtcaggcgatgtttgccggattaacaaacccgctgccggtggcgcgttatcactcgctggttggcagtaacattccggccggtttaaccatcaacgcccattttaatggcatggtgatggcagtacgtcacgatgcggatcgcgtttgtggattccagttccatccggaatccattctcaccacccagggcgctcgcctgctggaacaaacgctggcctgggcgcagcagaaactagagccagccaacacgctgcaaccgattctggaaaaactgtatcaggcgcagacgcttagccaacaagaaagccaccagctgttttcagcggtggtgcgtggcgagctgaagccggaacaactggcggcggcgctggtgagcatgaaaattcgcggtgagcacccgaacgagatcgccggggcagcaaccgcgctactggaaaacgcagcgccgttcccgcgcccggattatctgtttgctgatatcgtcggtactggcggtgacggcagcaacagtatcaatatttctaccgccagtgcgtttgtcgccgcggcctgtgggctgaaagtggcgaaacacggcaaccgtagcgtctccagtaaatctggttcgtccgatctgctggcggcgttcggtattaatcttgatatgaacgccgataaatcgcgccaggcgctggatgagttaggtgtatgtttcctctttgcgccgaagtatcacaccggattccgccacgcgatgccggttcgccagcaactgaaaacccgcaccctgttcaatgtgctggggccattgattaacccggcgcatccgccgctggcgttaattggtgtttatagtccggaactggtgctgccgattgccgaaaccttgcgcgtgctggggtatcaacgcgcggcggtggtgcacagcggcgggatggatgaagtttcattacacgcgccgacaatcgttgccgaactgcatgacggcgaaattaaaagctatcagctcaccgcagaagactttggcctgacaccctaccaccaggagcaactggcaggcggaacaccggaagaaaaccgtgacattttaacacgtttgttacaaggtaaaggcgacgccgcccatgaagcagccgtcgctgcgaacgtcgccatgttaatgcgcctgcatggccatgaagatctgcaagccaatgcgcaaaccgttcttgaggtactgcgcagtggttccgcttacgacagagtcaccgcactggcggcacgagggtaa

SEQ ID NO: 268 - DNA, 1563 bp, Escherichia coli
atgcaaacacaaaaaccgactctcgaactgctaacctgcgaaggcgcttatcgcgacaatcccaccgcgctttttcaccagttgtgtggggatcgtccggcaacgctgctgctggaatccgcagatatcgacagcaaagatgatttaaaaagcctgctgctggtagacagtgcgctgcgcattacagctttaggtgacactgtcacaatccaggcactttccggcaacggcgaagccctcctggcactactggataacgccctgcctgcgggtgtggaaagtgaacaatcaccaaactgccgtgtgctgcgcttcccccctgtcagtccactgctggatgaagacgcccgcttatgctccctttcggtttttgacgctttccgtttattgcagaatctgttgaatgtaccgaaggaagaacgagaagccatgttcttcggcggcctgttctcttatgaccttgtggcgggatttgaagatttaccgcaactgtcagcggaaaataactgccctgatttctgtttttatctcgctgaaacgctgatggtgattgaccatcagaaaaaaagcacccgtattcaggccagcctgtttgctccgaatgaagaagaaaaacaacgtctcactgctcgcctgaacgaactacgtcagcaactgaccgaagccgcgccgccgctgccagtggtttccgtgccgcatatgcgttgtgaatgtaatcagagcgatgaagagttcggtggcgtagtgcgtttgttgcaaaaagcgattcgcgctggagaaattttccaggtggtgccatctcgccgtttctctctgccctgcccgtcaccgctggcggcctattacgtgctgaaaaagagtaatcccagcccgtacatgttttttatgcaggataatgatttcaccctatttggcgcgtcgccggaaagctcgctcaagtatgatgccaccagccgccagattgagatctacccgattgccggaacacgcccacgcggtcgtcgcgccgatggttcactggacagagatctcgacagccgtattgaactggaaatgcgtaccgatcataaagagctgtctgaacatctgatgctggttgatctcgcccgtaatgatctggcacgcatttgcacccccggcagccgctacgtcgccgatctcaccaaagttgaccgttattcctatgtgatgcacctcgtctctcgcgtagtcggcgaactgcgtcacgatcttgacgccctgcacgcttatcgcgcctgtatgaatatggggacgttaagcggtgcgccgaaagtacgcgctatgcagttaattgccgaggcggaaggtcgtcgccgcggcagctacggcggcgcggtaggttatttcaccgcgcatggcgatctcgacacctgcattgtgatccgctcggcgctggtggaaaacggtatcgccaccgtgcaagcgggtgctggtgtagtccttgattctgttccgcagtcggaagccgacgaaacccgtaacaaagcccgcgctgtactgcgcgctattgccaccgcgcatcatgcacaggagactttctga

SEQ ID NO: 269 - DNA, 1359 bp, Escherichia coli
atgcaaaccgttttagcgaaaatcgtcgcagacaaggcgatttgggtagaagcccgcaaacagcagcaaccgctggccagttttcagaatgaggttcagccgagcacgcgacatttttatgatgcgctacagggtgcgcgcacggcgtttattctggagtgcaagaaagcgtcgccgtcaaaaggcgtgatccgtgatgatttcgatccagcacgcattgccgccatttataaacattacgcttcggcaatttcggtgctgactgatgagaaatattttcaggggagctttaatttcctccccatcgtcagccaaatcgccccgcagccgattttatgtaaagacttcattatcgacccttaccagatctatctggcgcgctattaccaggccgatgcctgcttattaatgctttcagtactggatgacgaccaatatcgccagcttgccgccgtcgctcacagtctggagatgggggtgctgaccgaagtcagtaatgaagaggaacaggagcgcgccattgcattgggagcaaaggtcgttggcatcaacaaccgcgatctgcgtgatttgtcgattgatctcaaccgtacccgcgagcttgcgccgaaactggggcacaacgtgacggtaatcagcgaatccggcatcaatacttacgctcaggtgcgcgagttaagccacttcgctaacggttttctgattggttcggcgttgatggcccatgacgatttgcacgccgccgtgcgccgggtgttgctgggtgagaataaagtatgtggcctgacgcgtgggcaagatgctaaagcagcttatgacgcgggcgcgatttacggtgggttgatttttgttgcgacatcaccgcgttgcgtcaacgttgaacaggcgcaggaagtgatggctgcggcaccgttgcagtatgttggcgtgttccgcaatcacgatattgccgatgtggtggacaaagctaaggtgttatcgctggcggcagtgcaactgcatggtaatgaagaacagctgtatatcgatacgctgcgtgaagctctgccagcacatgttgccatctggaaagcattaagcgtcggtgaaaccctgcccgcccgcgagtttcagcacgttgataaatatgttttagacaacggccagggtggaagcgggcaacgttttgactggtcactattaaatggtcaatcgcttggcaacgttctgctggcggggggcttaggcgcagataactgcgtggaagcggcacaaaccggctgcgccggacttgattttaattctgctgtagagtcgcaaccgggcatcaaagacgcacgtcttttggcctcggttttccagacgctgcgcgcatattaa

SEQ ID NO: 270 - DNA, 807 bp, Escherichia coli
atggaacgctacgaatctctgtttgcccagttgaaggagcgcaaagaaggcgcattcgttcctttcgtcacgctcggtgatccgggcattgagcagtcattgaaaattatcgatacgctaattgaagccggtgctgacgcgctggagttaggtatccccttctccgacccactggcggatggcccgacgattcaaaacgccactctgcgcgcctttgcggcaggtgtgactccggcacaatgttttgaaatgctggcactgattcgccagaaacacccgaccattcccattggcctgttgatgtatgccaatctggtgtttaacaaaggcattgatgagttttatgcccagtgcgaaaaagtcggcgtcgattcggtgctggttgccgatgtgccagttgaagagtccgcgcccttccgccaggccgcgttgcgtcataatgtcgcacctatcttcatctgcccgccaaatgccgatgacgacctgctgcgccagatagcctcttacggtcgtggttacacctatttgctgtcacgagcaggcgtgaccggcgcagaaaaccgcgccgcgttacccctcaatcatctggttgcgaagctgaaagagtacaacgctgcacctccattgcagggatttggtatttccgccccggatcaggtaaaagcagcgattgatgcaggagctgcgggcgcgatttctggttcggccattgttaaaatcatcgagcaacatattaatgagccagagaaaatgctggcggcactgaaagtttttgtacaaccgatgaaagcggcgacgcgcagttaa

SEQ ID NO: 271 - DNA, 1194 bp, Escherichia coli
atgacaacattacttaacccctattttggtgagtttggcggcatgtacgtgccacaaatcctgatgcctgctctgcgccagctggaagaagcttttgtcagtgcgcaaaaagatcctgaatttcaggctcagttcaacgacctgctgaaaaactatgccgggcgtccaaccgcgctgaccaaatgccagaacattacagccgggacgaacaccacgctgtatctcaagcgtgaagatttgctgcacggcggcgcgcataaaactaaccaggtgctggggcaggcgttgctggcgaagcggatgggtaaaaccgaaatcatcgccgaaaccggtgccggtcagcatggcgtggcgtcggcccttgccagcgccctgctcggcctgaaatgccgtatttatatgggtgccaaagacgttgaacgccagtcgcctaacgtttttcgtatgcgcttaatgggtgcggaagtgatcccggtgcatagcggttccgcgacgctgaaagatgcctgtaacgaggcgctgcgcgactggtccggtagttacgaaaccgcgcactatatgctgggcaccgcagctggcccgcatccttatccgaccattgtgcgtgagtttcagcggatgattggcgaagaaaccaaagcgcagattctggaaagagaaggtcgcctgccggatgccgttatcgcctgtgttggcggcggttcgaatgccatcggcatgtttgctgatttcatcaatgaaaccaacgtcggcctgattggtgtggagccaggtggtcacggtatcgaaactggcgagcacggcgcaccgctaaaacatggtcgcgtgggtatctatttcggtatgaaagcgccgatgatgcaaaccgaagacgggcagattgaagaatcttactccatctccgccggactggatttcccgtctgtcggcccacaacacgcgtatcttaacagcactggacgcgctgattacgtgtctattaccgatgatgaagcccttgaagccttcaaaacgctgtgcctgcacgaagggatcatcccggcgctggaatcctcccacgccctggcccatgcgttgaaaatgatgcgcgaaaacccggataaagagcagctactggtggttaacctttccggtcgcggcgataaagacatcttcaccgttcacgatattttgaaagcacgaggggaaatctga

SEQ ID NO: 272 - DNA, 1296 bp, Escherichia coli
gtgcaatcacttactacggcgctggaaaatctactgcgccatttgtcgcaagagattccggcgacacccggcattcgggttatcgatattcctttccctctcaaagacgcttttgatgccttgagctggctggccagtcagcaaacatacccgcaattctactggcaacaacgtaatggtgatgaagaagctgtcgtcctgggcgcgattacccgttttacgtcgttggaccaggcacaacgttttcttcgccagcacccggaacacgccgacttacgcatttgggggctgaatgcttttgacccgtcgcagggcaatttacttttaccccgcctggaatggcgacgctgtggcggtaaagccacgctgcggctgacgctattcagcgaaagctcccttcagcacgatgcgattcaggcaaaagaatttatcgccacactggtgagtatcaagcccttgcctgggttacatttaaccaccacgcgagaacaacactggccggacaaaacgggctggacgcaattaatcgaactggcaacgaaaaccatcgccgaaggtgagctcgacaaagtggtgctcgctcgggcaactgacctgcatttcgcaagtccggtcaacgcggcggcgatgatggctgccagtcgtcgactgaatctgaattgctaccatttttacatggcctttgatggcgaaaatgcttttcttggctcttcaccggaacggttatggcggcggcgtgacaaagcgctgcgtactgaagcgctggcgggaacagtagcaaataatcctgatgataagcaggcgcagcagttaggagagtggctgatggcggatgataaaaaccagcgcgagaacatgctggtggtggaagatatctgtcaacgattacaggccgatacccagacgctggatgttttaccgccgcaggtactgcgtctgcgtaaagtgcagcatcttcgccgctgtatctggacttcactcaacaaagcggatgatgtgatctgtttacatcagttgcagccaacggcagcagttgctggcttaccgcgcgatctggcgcgacagtttatcgcccgtcacgaaccgttcacccgagaatggtacgccggttctgcgggctatctctcattacaacaaagcgaattctgcgtttccctgcgctcagcaaaaattagcggcaatgtcgtgcgattatatgctggcgcgggcattgtccgtggttccgaccccgagcaagagtggcaggaaatcgacaacaaagcggcagggctgcgtactttattacaaatggaatag

SEQ ID NO: 273 - DNA, 1176 bp, Escherichia coli
atggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcgtcgctgtatattcctgaatcctggcagtcgttctcccgtcaggaaaaacaagcttccgcacgccgtttcacccgcagccagtcgctgaatgtggtggaacgccaggcaattccggagcaaaccacgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgttccgctggctgatggtggcgtcctgctgggggccagcccggaactgctgctacgtaaagacggcgagcgttttagctccattccgttagccggttccgcgcgtcgtcagccggatgaagtgctcgatcgcgaagcaggtaatcgtctgctggcgtcagaaaaagatcgccatgaacatgaactggtgactcaggcgatgaaagaggtactgcgcgaacgcagtagtgagttacacgttccttcttctccacagctgatcaccacgccgacgctgtggcatctcgcaactccctttgaaggtaaagcgaattcgcaagaaaacgcactgactctggcctgtctgctgcatccgacccccgcgctgagcggtttcccgcatcaggccgcgacccaggttattgctgaactggaaccgttcgaccgcgaactgtttggcggcattgtgggttggtgtgacagcgaaggtaacggcgaatgggtggtgaccatccgctgcgcgaagctgcgggaaaatcaggtgcgtctgtttgccggagcggggattgtgcctgcgtcgtcaccgttgggtgagtggcgcgaaacaggcgtcaaactttctaccatgttgaacgtttttggattgcattaa

SEQ ID NO: 274 - DNA, 1611 bp, Escherichia coli
atgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctga

SEQ ID NO: 275 - DNA, 3882 bp, Escherichia coli
atgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctacgaaccaacattgatccgcacggtactgcgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatggtcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaa

SEQ ID NO: 276 - DNA, 630 bp, Escherichia coli
atggtcgatatgaaaactacgcatacctccctcccctttgccggacatacgctgcattttgttgagttcgatccggcgaatttttgtgagcaggatttactctggctgccgcactacgcacaactgcaacacgctggacgtaaacgtaaaacagagcatttagccggacggatcgctgctgtttatgctttgcgggaatatggctataaatgtgtgcccgcaatcggcgagctacgccaacctgtctggcctgcggaggtatacggcagtattagccactgtgggactacggcattagccgtggtatctcgtcaaccgattggcattgatatagaagaaattttttctgtacaaaccgcaagagaattgacagacaacattattacaccagcggaacacgagcgactcgcagactgcggtttagccttttctctggcgctgacactggcattttccgccaaagagagcgcatttaaggcaagtgagatccaaactgatgcaggttttctggactatcagataattagctggaataaacagcaggtcatcattcatcgtgagaatgagatgtttgctgtgcactggcagataaaagaaaagatagtcataacgctgtgccaacacgattaa

SEQ ID NO: 277 - DNA, 858 bp, Escherichia coli
atggctattccaaaattacaggcttacgcactgccggagtctcacgatattccgcagaataaagttgactgggcctttgaaccgcaacgtgccgcgttgttaatccatgatatgcaggactattttgtcagcttctggggcgagaactgcccgatgatggagcaggtgatcgcgaatattgctgcgctgcgcgactactgcaaacagcacaatatcccggtttattacaccgcccagccgaaagagcagagcgatgaagatcgggcgctgttgaatgatatgtgggggccgggcctgacccgctcgccggaacagcaaaaggtggtggatcgcctgacgccagatgccgacgacacggtgctggtgaagtggcgctacagcgcgtttcatcgttctccgctggagcaaatgctgaaagagagtggacgtaaccagctgattattaccggggtatatgcccacattggctgtatgaccaccgcaaccgacgcatttatgcgcgatattaaaccgtttatggtggcggatgcgctggccgatttcagccgtgacgagcatttgatgtcgctgaaatatgtggccggacgttctggccgggtggtgatgactgaagaattactgccagcacctatccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggtgatatcgactttgtcatgctggcgaaaaacccgaccatcgacgcctggtggaagctactctcccgcgaggtgaaataa

SEQ ID NO: 278 - DNA, 1671 bp, Escherichia coli
atgtcagtaagcgcatttaaccgacgctgggcggcggtcattctggaagcattaacgcgtcacggcgtcagacacatctgtatcgccccaggctcgcgttctacaccgttaacgttagcggcggcggagaattccgcattcattcaccacacccatttcgatgagcgtgggttggggcatctggcgctggggctggcgaaagtcagcaagcagccggtggcggtgattgtgacctccggcacggcggtggcaaatctctatccggcactgattgaagccgggttaaccggagaaaaactgattctcttaaccgccgatcgcccgccggagctaattgactgcggcgcgaatcaggcaattcgccagccgggaatgttcgcctctcaccccacgcacagtatttcattgccgcgcccgacccaggatatccccgcacgttggctggtttctaccatcgaccacgctctcggtacgcttcatgcggggggagtccatatcaactgcccgtttgctgaaccgctgtatggcgaaatggacgataccgggcttagctggcaacagcgtctgggtgactggtggcaggacgacaaaccgtggctgcgtgaagcgcctcgtctggaaagtgaaaaacagcgcgactggttcttctggcgacaaaagcgcggcgtggtggttgccgggcgcatgagtgcggaagagggcaaaaaagttgccctgtgggcgcaaactcttggctggccgctgattggcgatgtgctgtcacaaaccgggcagccgctgccgtgtgccgatctttggttaggcaatgccaaagcgaccagcgagctgcagcaggcgcaaattgtggtgcaactgggaagcagcctgacggggaaacggctcctgcaatggcaggcaagctgtgaaccagaagagtactggattgttgatgacattgaagggcgacttgatccggcacaccatcgcggacgtcgcttaattgccaatattgccgactggctggagctgcatccggcagaaaaacgccagccctggtgcgttgaaatcccgcgcctggcggaacaggcaatgcaggcggttattgcccgccgtgatgcgtttggcgaagcgcaactggcgcatcgcatctgcgactatctgcctgaacaggggcaattgtttgttggtaacagcctggtggtacgtctgattgatgcgctttcgcaacttccggcaggttacccggtgtacagcaaccgtggggccagcggtatcgacgggctgctttcgaccgccgccggcgttcagcgggcaagcggcaaaccgacgctggcgattgtgggcgatctctccgcactttacgatctcaacgcgctggcgttattgcgtcaggtttctgcgccgctggtattaattgtggtgaacaacaacggcgggcaaattttctcgctgttgccaacgccgcaaagcgagcgtgagcgtttctatctgatgccgcaaaacgtccattttgagcacgccgccgcgatgttcgagctgaaatatcatcgtccgcaaaactggcaggaacttgaaacggcatttgccgacgcctggcgcacgccaaccaccacggtgattgaaatggtggttaacgacaccgatggtgcgcaaacgctccagcaacttctggcgcaggtaagccatttatga

SEQ ID NO: 279 - DNA, 759 bp, Escherichia coli
atgatcctgcacgcgcaggcaaaacacggaaaaccaggtttaccctggctggtgtttttgcacggtttttccggcgattgccacgaatggcaagaagtgggcgaggcgtttgccgactactcacggttgtatgttgatctcccaggtcacggtggttcggcggcgattagcgtcgatggatttgatgatgtcaccgacttactgcgtaaaaccttggttagttacaacatccttgacttctggctggtggggtactcgcttggtggacgggtggcgatgatggcggcttgccaggggctggcggggctttgtggggttattgtcgaaggcgggcatccggggctgcaaaatgctgaacaacgtgcggaacgtcagcgttccgatcgccaatgggtgcagcgttttctcacagaaccgttaacggcggtatttgccgactggtatcaacagcctgtttttgcctcactcaatgacgatcaacgccgggagctggtggcgctgcgcagcaacaataatggcgcaacgcttgccgccatgctggaggcgacttctctcgccgtccagcctgatttacgtgctaaccttagcgcccgcacatttgcgttttattatttatgtggtgaacgtgacagcaaattccgcgccctggcggcggaactggctgccgactgccatgtcattcctcgcgccggacataacgcgcatcgggaaaatcccgctggcgtaatcgcaagtctggcgcagatcttgcgtttctga

SEQ ID NO: 280 - DNA, 963 bp, Escherichia coli
atgcgtagcgcgcaggtataccgctggcagatccccatggacgcgggggtggttctgcgcgacaggcggttaaaaacccgcgacgggctgtatgtttgcctgcgtgaaggcgagcgcgaagggtggggggagatctccccactgccgggcttcagtcaggaaacctgggaagaggcgcaaagtgtgctgcttgcctgggtaaataactggctggcaggcgattgcgagctaccgcagatgccttccgtggcctttggcgtaagctgtgcattggcagaactgacagatacgttgccgcaagcagccaactaccgtgcggcaccgctgtgtaatggcgatccggacgatctgatcctcaaacttgcagatatgccaggcgagaaagtggcgaaggtcaaagtgggattgtacgaagcggtgcgcgacggcatggtggtgaatctgttgctggaggcaattccggatctgcatttgcgtcttgacgcaaatcgcgcctggacaccgctgaaaggtcagcagtttgccaaatacgttaacccggattatcgcgaccgcatcgcgtttctcgaagagccgtgcaaaacccgcgatgattcgcgagcgtttgcccgtgaaaccggcattgccattgcctgggatgaaagcctgcgcgagccggattttgcctttgtggctgaagagggcgtgcgcgcggtagttatcaaacccacgctcacgggcagtctggaaaaagtacgcgagcaggtacaggcggcgcacgcgctggggctgacggcggtgatcagttcttccattgaatcgagcttaggcttaacgcaactggcgcggattgccgcctggttaacgccggacaccattccagggctggacacgctggatctgatgcaggcgcagcaggtacgtcgctggccgggtagcacgctgcctgtcgtggaagttgatgcactggagcggttgttatga

SEQ ID NO: 281 - DNA, 1356 bp, Escherichia coli
atgatcttctctgactggccgtggcgtcactggcggcaagtgcggggagaaaccatcgccttacgtcttaatgacgagcaactcaactggcgcgagctttgtgctcgcgtcgatgaattagcctccggatttgcggtgcagggggtggttgagggcagcggcgtgatgttgcgggcgtggaatacgccgcaaacgctgctcgcctggctggcgttactgcaatgcggggcgcgggtgttgcccgtgaaccctcagctgccgcaaccgttgcttgaagaattgctgcccaatctgacgctgcaatttgctctggtgccggatggggaaaacacgtttccggcattaacgtcgctgcacattcagctggttgaaggcgcacatgccgctacgtggcagccgacgcgtctgtgctcaatgacgttgacctcgggttctaccggtttgccgaaagccgctgtccatacttatcaggcccatcttgccagtgcgcaaggtgtgttatcgctgattccgtttggcgatcacgatgattggttgctctctttaccgctgtttcacgtctccggtcagggaattatgtggcgctggttatacgctggtgcgcggatgacggtacgtgataaacagccattggagcaaatgctggcaggctgtactcacgcttcactggtgccaacacaactctggcgtttgctggttaaccgtagttccgtttccctgaaagcggtgttacttggcggcgcggctatcccggtcgagttgacggaacaggcgcgcgagcaggggattcgttgcttttgcggctatggtctgaccgagtttgcctccacggtgtgtgcgaaagaagccgacggcctggcagacgttggttcgccgctgccgggtcgggaagtgaaaatcgttaataatgaagtgtggctgcgggctgccagtatggcagaaggttactggcgtaacgggcaactggtttcactggttaatgacgaaggctggtacgctacgcgcgatcgcggtgagatgcataatggcaagctgaccattgtcggacgtttagacaatctattcttcagtggcggagagggtattcagccggaagaagtcgagcgcgtaattgctgcacatcctgcggttttgcaggtgtttatcgtccccgttgccgacaaggagtttggtcatcgaccggtggcggtgatggagtatgaccacgagagcgttgatcttagtgaatgggtgaaagataagctggcccgttttcaacaaccggtgcgctggctaactctgccgccggagctgaaaaacggcggtattaaaatttcacgtcaggcgctaaaagagtgggtgcaacgtcagcaataa

SEQ ID NO: 282 - DNA, 858 bp, Escherichia coli
atgatttatcctgatgaagcaatgctttacgcaccggttgaatggcacgactgctccgaaggtttcgaggacattcgttatgaaaaatccaccgacggtatcgcaaaaatcaccattaatcgtccgcaggtgcgcaatgccttccgtcctctgacggtaaaagagatgatccaggcgctggcagatgcgcgttatgacgacaacatcggcgtgatcattctgactggtgcaggcgataaagcgttctgctccggtggtgaccagaaagtgcgtggtgattacggcggctataaagatgattccggcgtacatcacctgaatgtgctggacttccagcgtcagatccgtacctgtccgaaaccggttgtcgcgatggtggctggctactccatcggcggcggtcacgttctgcacatgatgtgcgacctgactatcgcggcagataatgccatcttcggtcagactggcccgaaagtcggttccttcgacggcggctggggcgcttcctacatggctcgcatcgtcgggcagaaaaaagcgcgtgaaatctggttcctgtgccgtcagtacgacgcaaaacaggcgctggatatgggccttgtgaacaccgtggtaccgctggcggatctggaaaaagaaaccgtccgttggtgccgcgaaatgctgcaaaacagcccgatggcgctgcgctgcctgaaagctgcactgaacgccgactgtgacgggcaggcggggctgcaggagctggcgggcaacgccaccatgctgttctacatgacggaagaaggtcaggaaggtcgcaacgccttcaaccagaaacgtcagcctgacttcagcaaattcaaacggaatccgtaa

SEQ ID NO: 283 - DNA, 927 bp, Escherichia coli
atgactgaacaacaaattagccgaactcaggcgtggctggaaagtttacgacctaaaaccctccccctcgcctttgctgcaattatcgtcgggacagcgctggcatggtggcaaggtcacttcgatccgctggtcgccctgctggcactaattaccgccgggctattacagatcctttctaacctcgccaatgattacggcgatgcggtaaaaggcagcgataaacctgaccgcattgggccgctacgcggcatgcaaaaaggggtcattacccagcaagagatgaaacgggcgctcattattaccgtcgtgctcatctgtctctccgggctggcactggttgcagtggcatgccatacgctggccgattttgtcggtttcctgattcttggcgggttgtcgatcattgccgctatcacctacaccgtgggcaatcgtccttatggttatatcggtctgggtgatatttccgtactggttttctttggctggttgagtgtcatggggagctggtatttacaggctcatacattgattccggcactgatccttccggcgaccgcatgcggcctgctggcaacggcagtactgaatattaataacctgcgtgatatcaatagcgaccgcgaaaatggcaaaaacacgctggtggtgcgcttaggtgaagtgaacgcgcgtcgttatcatgcctgcctgctgatgggctcgctggtgtgtctggcgctgtttaatctcttttcgctgcatagcctgtggggctggctgttcctgctggcggcaccattactggtgaagcaagcccgttatgtgatgcgggaaatggacccggtggcgatgcgaccaatgctggaacgtactgtcaagggagcgttactgactaacctgctgtttgttttagggatattcctaagccagtgggcagcataa

SEQ ID NO: 284 - DNA, 669 bp, Escherichia coli
atgccatcactcagtaaagaagcggccctggttcatgaagcgttagttgcgcgaggactggaaacaccgctgcgcccgcccgtgcatgaaatggataacgaaacgcgcaaaagccttattgctggtcatatgaccgaaatcatgcagctgctgaatctcgacctggctgatgacagtttgatggaaacgccgcatcgcatcgctaaaatgtatgtcgatgaaattttctccggtctggattacgccaatttcccgaaaatcaccctcattgaaaacaaaatgaaggtcgatgaaatggtcaccgtgcgcgatatcactctgaccagcacctgtgaacaccattttgttaccatcgatggcaaagcgacggtggcctatatcccgaaagattcggtgatcggtctgtcaaaaattaaccgcattgtgcagttctttgcccagcgtccgcaggtgcaggaacgtctgacgcagcaaattcttattgcgctacaaacgctgctgggcaccaataacgtggctgtctcgatcgacgcggtgcattactgcgtgaaggcgcgtggcatccgcgatgcaaccagtgccacgacaacgacctctcttggtggattgttcaaatccagtcagaatacgcgccacgagtttctgcgcgctgtgcgtcatcacaactga

SEQ ID NO: 285 - DNA, 453 bp, Escherichia coli
gtgaaggataaagtgtataagcgtcccgtttcgatcttagtggtcatctacgcacaagatacgaaacgggtgctgatgttgcagcggcgtgacgatcccgatttctggcagtcggtaaccggcagcgtggaagagggtgaaaccgcgccgcaagctgccatgcgcgaagtaaaggaagaggtcaccattgatgttgtcgctgaacaactgaccttaattgactgtcagcgcacggtagagtttgaaattttttcacatttacgtcatcgctatgcgccgggcgtgacgcgtaatacggaatcatggttctgtcttgcgcttccgcacgagcggcagatcgttttcactgaacatctggcttacaagtggcttgatgcgcctgctgcggcggcgctcactaagtcctggagcaaccggcaggcgattgaacagtttgtaattaacgctgcctga

SEQ ID NO: 286 - DNA, 369 bp, Escherichia coli
atggatattgtatttatagagcaactttcggtaatcaccactattggtgtttacgactgggaacagaccatcgaacagaagttagtgttcgatatcgaaatggcgtgggataaccgtaaagcggcgaaaagtgatgatgtggcggattgcctcagttacgctgacattgcagaaacggtggtcagccacgtcgagggggcgcgttttgcgctggtggaacgcgtggctgaagaggtggcggagctgctgttagcacgcttcaactcgccgtgggtgcgtatcaaactcagcaagccaggcgcagtggcgcgggcggcgaatgttggcgtaatcattgagcgtggcaataatctgaaagaaaataattaa

SEQ ID NO: 287 - DNA, 480 bp, Escherichia coli
atgacagtggcgtatattgccataggcagcaatctggcctctccgctggagcaggtcaatgctgccctgaaagcattaggcgatatccctgaaagccacattcttaccgtttcttcgttttaccgcaccccaccgctggggccgcaagatcaacccgattacttaaacgcagccgtggcgctggaaacctctcttgcacctgaagagctactcaatcacacacagcgtattgaattgcagcaaggtcgcgtccgcaaagctgaacgctggggaccacgcacgctggatctcgacatcatgctgtttggtaatgaagtgataaatactgaacgcctgaccgttccgcactacgatatgaagaatcgtggatttatgctgtggccgctgtttgaaatcgcgccggagttggtgtttcctgatggggagatgttgcgtcaaatcttacatacaagagcatttgacaaattaaacaaatggtaa

SEQ ID NO: 288 - DNA, 810 bp, Escherichia coli
atgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtgctgaaagtcgtgatcagtcgcggtagtggcgggcgagggtacagcacattgaacagcggaccggcaacgcggattctctccgttacggcttatcctgcacattacgaccgtttgcgtaacgaggggattacgttggcgctaagcccggtgcggctggggcgcaatcctcatcttgcaggtattaaacatctcaatcgtcttgagcaagtattgattcgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagagtcgttgcaggcagatgagatggttatttgtaatgcgttaatgccagtgatgcccgtatgtgcctgtggcgatgtctccttttcgtcagcaacgttatatgaatatttagccccactttgtgagcgcccgaattag

SEQ ID NO: 289 - DNA, 849 bp, Escherichia coli
atgaaactctttgcccagggtacttcactggaccttagccatcctcacgtaatggggatcctcaacgtcacgcctgattccttttcggatggtggcacgcataactcgctgatagatgcggtgaaacatgcgaatctgatgatcaacgctggcgcgacgatcattgacgttggtggcgagtccacgcgcccaggggcggcggaagttagcgttgaagaagagttgcaacgtgttattcctgtggttgaggcaattgctcaacgcttcgaagtctggatctcagtcgatacatccaaaccagaagtcatccgtgagtcagcgaaagttggcgctcacattattaatgatatccgctccctttccgaacctggcgctctggaggcggctgcagaaaccggtttaccggtttgtctgatgcatatgcagggaaatccaaaaaccatgcaggaagctccgaagtatgacgatgtctttgcagaagtgaatcgctactttattgagcaaatagcacgttgcgagcaggcgggtatcgcaaaagagaaattgttgctcgaccccggattcggtttcggtaaaaatctctcccataactattcattactggcgcgcctggctgaatttcaccatttcaacctgccgctgttggtgggtatgtcacgaaaatcgatgattgggcagctgctgaacgtggggccgtccgagcgcctgagcggtagtctggcctgtgcggtcattgccgcaatgcaaggcgcgcacatcattcgtgttcatgacgtcaaagaaaccgtagaagcgatgcgggtggtggaagccactctgtctgcaaaggaaaacaaacgctatgagtaa

SEQ ID NO: 290 - DNA, 1269 bp, Escherichia coli
atgattatcaaacgcactcctcaagccgcgtcgcctctggcttcgtggctttcttatctggaaaacctgcacagtaaaactatcgatctcggccttgagcgcgtgagcctggtcgcggcgcgtcttggcgtcctgaaaccagcgccatttgtgtttaccgttgcgggtacgaatggcaaaggcaccacctgccgtacgctggagtcgattctgatggcggcagggtacaaagtgggcgtctacagttcgcctcatctggtgcgttataccgagcgcgtacgtgtgcagggccaggaattgccggaatcggcccacaccgcctcttttgcggagattgaatcggcacgcggtgatatttccctgacctatttcgagtacggtacgctgtcggcgttgtggctgttcaagcaggcacaacttgacgtggtgattctggaagtagggctgggcggtcgtctggacgcaaccaatattgtcgacgccgatgtcgcggtagtaaccagtattgcgctggatcataccgactggctgggtccagatcgcgaaagtattggtcgcgagaaagcaggcatcttccgcagcgaaaaaccggcaattgtcggtgagccggaaatgccttctaccattgctgatgtggcgcaggaaaaaggtgcactgttacaacgtcggggcgttgagtggaactattccgtcaccgatcatgactgggcgtttagcgatgctcacggcacgctggaaaatctgccgttgccgcttgtcccgcaaccgaatgccgcaacagcgctggcggcactgcgtgccagcgggctggaagtcagtgaaaatgccattcgcgacgggattgccagcgcaattttgccgggacgtttccagattgtgagcgagtcgccacgcgttatttttgatgtcgcgcataatccacatgcggcggaatatctcaccgggcgtatgaaagcgctaccgaaaaacgggcgcgtgctggcggttatcggtatgctacatgataaagatattgccggaactctggcctggttgaaaagcgtggttgatgactggtattgtgcgccactggaagggccgcgcggtgccacggcagaacaactgcttgagcatttgggtaacggcaaatcatttgatagcgttgcgcaggcatgggatgccgcaatggcggacgctaaagcggaagacaccgtgctggtgtgtggttctttccacacggtcgcacatgtcatggaagtgattgacgcgaggagaagcggtggcaagtaa

SEQ ID NO: 291 - DNA, 480 bp, Escherichia coli
atgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaa

SEQ ID NO: 292 - DNA, 723 bp, Escherichia coli
atgggtaaaacccagcccttgccaatattaattactggcggaggtcgtcgcatcggcctcgccctcgcatggcatttcattaatcaaaagcaaccggtgattgtcagctatcggacacactatccagccattgatggactgattaatgcaggtgcgcagtgtattcaggctgatttttcgaccaacgacggtgtgatggcgtttgccgatgaagtactaaaaagcacccatggtctgcgtgctattttgcataacgccagtgcgtggatggcggaaaaaccgggtgcgccactggccgacgtactggcttgcatgatgcagatccacgttaataccccatacctgctcaaccatgcgctggaaagattactgcgtgggcacggacacgccgccagcgatatcattcactttaccgattatgtggtggagcgcggtagcgacaaacatattgcgtatgctgcaagcaaagcggcactggataatatgacccgctcgtttgcccgcaagctggcaccggaagtgaaagtgaattctattgcgccatcgctgatcctgtttaatgaacatgatgatgccgaatatcgacaacaggcgctgaataaatcactgatgaaaaccgcgcctggcgagaaagaagtgatcgacctggtcgattacttacttaccagttgctttgtcaccggacgcagtttcccacttgatggcggtcgtcatctgcgttaa

SEQ ID NO: 293 - DNA, 639 bp, Escherichia coli
atgaatattgtggtgcttatttccggcaacggaagtaatttacaggcaattattgacgcctgtaaaaccaacaaaattaaaggcaccgtacgggcagttttcagcaataaggccgacgcgttcggccttgaacgcgcccgccaggcgggtattgcaacgcatacgctcatcgccagcgcgtttgacagtcgtgaagcctatgaccgggagttgattcatgaaatcgacatgtacgcacccgatgtggtcgtgctggctggttttatgcgcattctcagcccggcgtttgtctcccactatgccgggcgtttgctgaacattcacccttctctgctgccgaaatatcccggattacacacccatcgtcaggcgctggaaaatggcgatgaagagcacggtacatcggtgcatttcgtcaccgatgaactggacggtggcccggttattttacaggcgaaagtcccggtatttgctggtgattcggaagatgacatcaccgcccgcgtgcaaacccaggaacacgccatttatccactggtgattagctggtttgccgatggtcgtctgaaaatgcacgaaaacgccgcgtggctggatggtcaacgtctgccgccgcagggctacgctgccgacgagtaa

SEQ ID NO: 294 - DNA, 867 bp, Escherichia coli
atggcagcaaagattattgacggtaaaacgattgcgcagcaggtgcgctctgaagttgctcaaaaagttcaggcgcgtattgcagccggactgcgggcaccaggactggccgttgtgctggtgggtagtaaccctgcatcgcaaatttatgtcgcaagcaaacgcaaggcttgtgaagaagtcgggttcgtctcccgctcttatgacctcccggaaaccaccagcgaagcggagctgctggagcttatcgatacgctgaatgccgacaacaccatcgatggcattctggttcaactgccgttaccggcgggtattgataacgtcaaagtgctggaacgtattcatccggacaaagacgtggacggtttccatccttacaacgtcggtcgtctgtgccagcgcgcgccgcgtctgcgtccctgcaccccgcgcggtatcgtcacgctgcttgagcgttacaacattgataccttcggcctcaacgccgtggtgattggcgcatcgaatatcgttggccgcccgatgagcatggaactgctgctggcaggttgcaccactacagtgactcaccgcttcactaaaaatctgcgtcatcacgtagaaaatgccgatctattgatcgttgccgttggcaagccaggctttattcccggtgactggatcaaagaaggcgcaattgtgattgatgtcggcatcaaccgtctggaaaatggcaaagttgtgggcgacgtcgtgtttgaagacgcggctaaacgcgcctcatacattacgcctgttcccggcggcgttggcccgatgacggttgccacgctgattgaaaacacgctacaggcgtgcgttgaatatcatgatccacaggatgagtaa

SEQ ID NO: 295 - DNA, 1191 bp, Escherichia coli; identical to SEQ ID NO: 239

SEQ ID NO: 296 - DNA, 135 bp, Escherichia coli
atggttcagtgtgttcgacattttgtcttaccgcgtctgaaaaaagacgctggcctgccgtttttcttcccgttgatcacccattcccagcccctcaatcgaggggcttttttttgcccaggcgtcaggagataa

SEQ ID NO: 297 - DNA, 936 bp, Escherichia coli
atggctaatccgctatatcagaaacatatcatttccataaacgaccttagtcgcgatgaccttaatctggtgctggcgacagcggcgaaactgaaagcaaacccgcaaccagagctgttgaagcacaaagtcattgccagctgtttcttcgaagcctctacccgtacccgcctctctttcgaaacatctatgcaccgcctgggggccagcgtggtgggcttctccgacagcgccaatacatcactgggtaaaaagggcgaaacgctggccgataccatttcggttatcagcacttacgtcgatgcgatagtgatgcgtcatccgcaggaaggtgcggcgcgcctggccaccgagttttccggcaatgtaccggtactgaatgccggtgatggctccaaccaacatccgacgcaaaccttgctggacttattcactattcaggaaacccaggggcgtctggacaatctccacgtcgcaatggttggtgacctgaaatatggccgcaccgttcactccctgactcaggcgttagcgaagttcgacggcaaccgtttttacttcatcgcgccggacgcgctggcaatgccgcaatacattctggatatgctcgatgaaaaagggatcgcatggagtctgcacagctctattgaagaagtgatggcggaagtagacatcctgtacatgacccgcgtgcaaaaagagcgtctggacccgtccgagtacgccaacgtgaaagcgcagtttgttcttcgcgccagcgatctccacaacgccaaagccaatatgaaagtgctgcatccgctgccgcgtgttgatgagattgcgacggatgttgataaaacgccacacgcctggtacttccagcaggcaggcaacgggattttcgctcgccaggcgttactggcactggttctgaatcgcgatctggtactgtaa

SEQ ID NO: 298 - DNA, 1350 bp, Escherichia coli
atgtctgaaattgttgtctccaaatttggcggtaccagcgtagctgattttgacgccatgaaccgcagcgctgatattgtgctttctgatgccaacgtgcgtttagttgtcctctcggcttctgctggtatcactaatctgctggtcgctttagctgaaggactggaacctggcgagcgattcgaaaaactcgacgctatccgcaacatccagtttgccattctggaacgtctgcgttacccgaacgttatccgtgaagagattgaacgtctgctggagaacattactgttctggcagaagcggcggcgctggcaacgtctccggcgctgacagatgagctggtcagccacggcgagctgatgtcgaccctgctgtttgttgagatcctgcgcgaacgcgatgttcaggcacagtggtttgatgtacgtaaagtgatgcgtaccaacgaccgatttggtcgtgcagagccagatatagccgcgctggcggaactggccgcgctgcagctgctcccacgtctcaatgaaggcttagtgatcacccagggatttatcggtagcgaaaataaaggtcgtacaacgacgcttggccgtggaggcagcgattatacggcagccttgctggcggaggctttacacgcatctcgtgttgatatctggaccgacgtcccgggcatctacaccaccgatccacgcgtagtttccgcagcaaaacgcattgatgaaatcgcgtttgccgaagcggcagagatggcaacttttggtgcaaaagtactgcatccggcaacgttgctacccgcagtacgcagcgatatcccggtctttgtcggctccagcaaagacccacgcgcaggtggtacgctggtgtgcaataaaactgaaaatccgccgctgttccgcgctctggcgcttcgtcgcaatcagactctgctcactttgcacagcctgaatatgctgcattctcgcggtttcctcgcggaagttttcggcatcctcgcgcggcataatatttcggtagacttaatcaccacgtcagaagtgagcgtggcattaacccttgataccaccggttcaacctccactggcgatacgttgctgacgcaatctctgctgatggagctttccgcactgtgtcgggtggaggtggaagaaggtctggcgctggtcgcgttgattggcaatgacctgtcaaaagcctgcggcgttggcaaagaggtattcggcgtactggaaccgttcaacattcgcatgatttgttatggcgcatccagccataacctgtgcttcctggtgcccggcgaagatgccgagcaggtggtgcaaaaactgcatagtaatttgtttgagtaa

SEQ ID NO: 299 - DNA, 2433 bp, Escherichia coli
atgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgaccttgagcgcctggcggcgctgctcgacagcggtattaacgacgcagtgtatgcggaagtggtgggccacggggaagtatggtcggcacgtctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaa

SEQ ID NO: 300 - DNA, 2463 bp, Escherichia coli; identical to SEQ ID NO: 19

SEQ ID NO: 301 - DNA, 1104 bp, Escherichia coli
atgaaaaatgttggttttatcggctggcgcggtatggtcggctccgttctcatgcaacgcatggttgaagagcgcgacttcgacgccattcgccctgtcttcttttctacttctcagcttggccaggctgcgccgtcttttggcggaaccactggcacacttcaggatgcctttgatctggaggcgctaaaggccctcgatatcattgtgacctgtcagggcggcgattataccaacgaaatctatccaaagcttcgtgaaagcggatggcaaggttactggattgacgcagcatcgtctctgcgcatgaaagatgacgccatcatcattcttgaccccgtcaatcaggacgtcattaccgacggattaaataatggcatcaggacttttgttggcggtaactgtaccgtaagcctgatgttgatgtcgttgggtggtttattcgccaatgatcttgttgattgggtgtccgttgcaacctaccaggccgcttccggcggtggtgcgcgacatatgcgtgagttattaacccagatgggccatctgtatggccatgtggcagatgaactcgcgaccccgtcctctgctattctcgatatcgaacgcaaagtcacaaccttaacccgtagcggtgagctgccggtggataactttggcgtgccgctggcgggtagcctgattccgtggatcgacaaacagctcgataacggtcagagccgcgaagagtggaaagggcaggcggaaaccaacaagatcctcaacacatcttccgtaattccggtagatggtttatgtgtgcgtgtcggggcattgcgctgccacagccaggcattcactattaaattgaaaaaagatgtgtctattccgaccgtggaagaactgctggctgcgcacaatccgtgggcgaaagtcgttccgaacgatcgggaaatcactatgcgtgagctaaccccagctgccgttaccggcacgctgaccacgccggtaggccgcctgcgtaagctgaatatgggaccagagttcctgtcagcctttaccgtgggcgaccagctgctgtggggggccgcggagccgctgcgtcggatgcttcgtcaactggcgtaa

SEQ ID NO: 302 - DNA, 879 bp, Escherichia coli
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaa

SEQ ID NO: 303 - DNA, 930 bp, Escherichia coli
atgccgattcgtgtgccggacgagctacccgccgtcaatttcttgcgtgaagaaaacgtctttgtgatgacaacttctcgtgcgtctggtcaggaaattcgtccacttaaggttctgatccttaacctgatgccgaagaagattgaaactgaaaatcagtttctgcgcctgctttcaaactcacctttgcaggtcgatattcagctgttgcgcatcgattcccgtgaatcgcgcaacacgcccgcagagcatctgaacaacttctactgtaactttgaagatattcaggatcagaactttgacggtttgattgtaactggtgcgccgctgggcctggtggagtttaatgatgtcgcttactggccgcagatcaaacaggtgctggagtggtcgaaagatcacgtcacctcgacgctgtttgtctgctgggcggtacaggccgcgctcaatatcctctacggcattcctaagcaaactcgcaccgaaaaactctctggcgtttacgagcatcatattctccatcctcatgcgcttctgacgcgtggctttgatgattcattcctggcaccgcattcgcgctatgctgactttccggcagcgttgattcgtgattacaccgatctggaaattctggcagagacggaagaaggggatgcatatctgtttgccagtaaagataagcgcattgcctttgtgacgggccatcccgaatatgatgcgcaaacgctggcgcaggaatttttccgcgatgtggaagccggactagacccggatgtaccgtataactatttcccgcacaatgatccgcaaaatacaccgcgagcgagctggcgtagtcacggtaatttactgtttaccaactggctcaactattacgtctaccagatcacgccatacgatctacggcacatgaatccaacgctggattaa

SEQ ID NO: 304 - DNA, 1161 bp, Escherichia coli
atgacgcgtaaacaggccaccatcgcagtgcgtagcgggttaaatgacgacgaacagtatggttgcgttgtcccaccgatccatctttccagcacctataactttaccggatttaatgaaccgcgcgcgcatgattactcgcgtcgcggcaacccaacgcgcgatgtggttcagcgtgcgctggcagaactggaaggtggtgctggtgcagtacttactaataccggcatgtccgcgattcacctggtaacgaccgtctttttgaaacctggcgatctgctggttgcgccgcacgactgctacggcggtagctatcgcctgttcgacagtctggcgaaacgcggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgcacgaaatatctgaacggtcactcagacgtagtggccggcgtggtgattgctaaagacccggacgttgtcactgaactggcctggtgggcaaacaatattggcgtgacgggcggcgcgtttgacagctatctgctgctacgtgggttgcgaacgctggtgccgcgtatggagctggcgcagcgcaacgcgcaggcgattgtgaaatacctgcaaacccagccgttggtgaaaaaactgtatcacccgtcgttgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaa

SEQ ID NO: 305 - DNA, 912 bp, Escherichia coli
gtgagtacattagaacaaacaataggcaatacgcctctggtgaagttgcagcgaatggggccggataacggcagtgaagtgtggttaaaactggaaggcaataacccggcaggttcggtgaaagatcgtgcggcactttcgatgatcgtcgaggcggaaaagcgcggggaaattaaaccgggtgatgtcttaatcgaagccaccagtggtaacaccggcattgcgctggcaatgattgccgcgctgaaaggctatcgcatgaaattgctgatgcccgacaacatgagccaggaacgccgtgcggcgatgcgtgcttatggtgcggaactgattcttgtcaccaaagagcagggcatggaaggtgcgcgcgatctggcgctggagatggcgaatcgtggcgaaggaaagctgctcgatcagttcaataatcccgataacccttatgcgcattacaccaccactgggccggaaatctggcagcaaaccggcgggcgcatcactcattttgtctccagcatggggacgaccggcactatcaccggcgtctcacgctttatgcgcgaacaatccaaaccggtgaccattgtcggcctgcaaccggaagagggcagcagcattcccggcattcgccgctggcctacggaatatctgccggggattttcaacgcttctctggtggatgaggtgctggatattcatcagcgcgatgcggaaaacaccatgcgcgaactggcggtgcgggaaggaatattctgtggcgtcagctccggcggcgcggttgccggagcactgcgggtggcaaaagctaaccctgacgcggtggtggtggcgatcatctgcgatcgtggcgatcgctacctttctaccggggtgtttggggaagagcattttagccagggggcggggatttaa

SEQ ID NO: 306 - DNA, 972 bp, Escherichia coli
atgagtaagatttttgaagataactcgctgactatcggtcacacgccgctggttcgcctgaatcgcatcggtaacggacgcattctggcgaaggtggaatctcgtaaccccagcttcagcgttaagtgccgtatcggtgccaacatgatttgggatgccgaaaagcgcggcgtgctgaaaccaggcgttgaactggttgaaccgaccagcggtaataccgggattgcactggcctatgtagctgccgctcgcggttacaaactcaccctgaccatgccagaaaccatgagtattgaacgccgcaagctgctgaaagcgttaggtgcaaacctggtgctgacggaaggtgctaaaggcatgaaaggcgcaatccaaaaagcagaagaaattgtcgccagcaatccagagaaatacctgctgctgcaacaattcagcaatccggcaaaccctgaaattcacgaaaagaccaccggtccggagatatgggaagataccgacggtcaggttgatgtatttattgctggcgttgggactggcggtacgctgactggcgtcagccgctacattaaaggcaccaaaggcaagaccgatcttatctctgtcgccgttgagccaaccgattctccagttatcgcccaggcgctggcaggtgaagagattaaacctggcccgcataaaattcagggtattggcgctggttttatcccggctaacctcgatctcaagctggtcgataaagtcattggcatcaccaatgaagaagcgatttctaccgcgcgtcgtctgatggaagaagaaggtattcttgcaggtatctcttctggagcagctgttgccgcggcgttgaaactacaagaagatgaaagctttaccaacaagaatattgtggttattctaccatcatcgggtgagcgttatttaagcaccgcattgtttgccgatctcttcactgagaaagaattgcaacagtaa

SEQ ID NO: 307 - DNA, 1173 bp, Escherichia coli
atgttcgatttttcaaaggtcgtggatcgtcatggcacatggtgtacacagtgggattatgtcgctgaccgtttcggcactgctgacctgttaccgttcacgatttcagacatggattttgccactgccccctgcattatcgaggcgctgaatcagcgcctgatgcacggcgtatttggctacagccgctggaaaaacgatgagtttctcgcggctattgcccactggttttccacccagcattacaccgccatcgattctcagacggtggtgtatggcccttctgtcatctatatggtttcagaactgattcgtcagtggtctgaaacaggtgaaggcgtggtgatccacacacccgcctatgacgcattttacaaggccattgaaggtaaccagcgcacagtaatgcccgttgctttagagaagcaggctgatggttggttttgcgatatgggcaagttggaagccgtgttggcgaaaccagaatgtaaaattatgctcctgtgtagcccacagaatcctaccgggaaagtgtggacgtgcgatgagctggagatcatggctgacctgtgcgagcgtcatggtgtgcgggttatttccgatgaaatccatatggatatggtttggggcgagcagccgcatattccctggagtaatgtggctcgcggagactgggcgttgctaacgtcgggctcgaaaagtttcaatattcccgccctgaccggtgcttacgggattatagaaaatagcagtagccgcgatgcctatttatcggcactgaaaggccgtgatgggctttcttccccttcggtactggcgttaactgcccatatcgccgcctatcagcaaggcgcgccgtggctggatgccttacgcatctatctgaaagataacctgacgtatatcgcagataaaatgaacgccgcgtttcctgaactcaactggcagatcccacaatccacttatctggcatggcttgatttacgtccgttgaatattgacgacaacgcgttgcaaaaagcacttatcgaacaagaaaaagtcgcgatcatgccggggtatacctacggtgaagaaggtcgtggttttgtccgtctcaatgccggctgcccacgttcgaaactggaaaaaggtgtggctggattaattaacgccatccgcgctgttcgttaa

SEQ ID NO: 308 - DNA, 1188 bp, Escherichia coli
atggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagttgcgcgagttaaccaccctgctctgcctggcagtaaaggtcacgaattctggaaacgagactttacaggcagcagcgggctattttcctttgtgcttaagaaaaaactcaataatgaagagctggcgaactatctggataacttcagtttattcagcatggcctactcgtggggcgggtatgaatcgttgatcctggcaaatcaaccagaacatatcgccgccattcgcccacaaggcgagatcgattttagcgggaccttgattcgcctgcatattggtctggaagatgtcgacgatctgattgccgatctggacgccggttttgcgcgaattgtataa

SEQ ID NO: 309 - DNA, 2262 bp, Escherichia coli
atgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaa

SEQ ID NO: 310 - DNA, 3684 bp, Escherichia coli
gtgagcagcaaagtggaacaactgcgtgcgcagttaaatgaacgtattctggtgctggacggcggtatgggcaccatgatccagagttatcgactgaacgaagccgattttcgtggtgaacgctttgccgactggccatgcgacctcaaaggcaacaacgacctgctggtactcagtaaaccggaagtgatcgccgctatccacaacgcctactttgaagcgggcgcggatatcatcgaaaccaacaccttcaactccacgaccattgcgatggcggattaccagatggaatccctgtcggcggaaatcaactttgcggcggcgaaactggcgcgagcttgtgctgacgagtggaccgcgcgcacgccagagaaaccgcgctacgttgccggtgttctcggcccgaccaaccgcacggcgtctatttctccggacgtcaacgatccggcatttcgtaatatcacttttgacgggctggtggcggcttatcgagagtccaccaaagcgctggtggaaggtggcgcggatctgatcctgattgaaaccgttttcgacacccttaacgccaaagcggcggtatttgcggtgaaaacggagtttgaagcgctgggcgttgagctgccgattatgatctccggcaccatcaccgacgcctccgggcgcacgctctccgggcagaccaccgaagcattttacaactcattgcgccacgccgaagctctgacctttggcctgaactgtgcgctggggcccgatgaactgcgccagtacgtgcaggagctgtcacggattgcggaatgctacgtcaccgcgcacccgaacgccgggctacccaacgcctttggtgagtacgatctcgacgccgacacgatggcaaaacagatacgtgaatgggcgcaagcgggttttctcaatatcgtcggcggctgctgtggcaccacgccacaacatattgcagcgatgagtcgtgcagtagaaggattagcgccgcgcaaactgccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtcgcgcgtcaacaggtggaaaacggcgcgcagattatcgatatcaacatggatgaagggatgctcgatgccgaagcggcgatggtgcgttttctcaatctgattgccggtgaaccggatatcgctcgcgtgccgattatgatcgactcctcaaaatgggacgtcattgaaaaaggtctgaagtgtatccagggcaaaggcattgttaactctatctcgatgaaagagggcgtcgatgcctttatccatcacgcgaaattgttgcgtcgctacggtgcggcagtggtggtaatggcctttgacgaacagggacaggccgatactcgcgcacggaaaatcgagatttgccgtcgggcgtacaaaatcctcaccgaagaggttggcttcccgccagaagatatcatcttcgacccaaacatcttcgcggtcgcaactggcattgaagagcacaacaactacgcgcaggactttatcggcgcgtgtgaagacatcaaacgcgaactgccgcacgcgctgatttccggcggcgtatctaacgtttctttctcgttccgtggcaacgatccggtgcgcgaagccattcacgcagtgttcctctactacgctattcgcaatggcatggatatggggatcgtcaacgccgggcaactggcgatttacgacgacctacccgctgaactgcgcgacgcggtggaagatgtgattcttaatcgtcgcgacgatggcaccgagcgtttactggagcttgccgagaaatatcgcggcagcaaaaccgacgacaccgccaacgcccagcaggcggagtggcgctcgtgggaagtgaataaacgtctggaatactcgctggtcaaaggcattaccgagtttatcgagcaggataccgaagaagcccgccagcaggctacgcgcccgattgaagtgattgaaggcccgttgatggacggcatgaatgtggtcggcgacctgtttggcgaagggaaaatgttcctgccacaggtggtcaaatcggcgcgcgtcatgaaacaggcggtggcctacctcgaaccgtttattgaagccagcaaagagcagggcaaaaccaacggcaagatggtgatcgccaccgtgaagggcgacgtccacgacatcggtaaaaatatcgttggtgtggtgctgcaatgtaacaactacgaaattgtcgatctcggcgttatggtgcctgcggaaaaaattctccgtaccgctaaagaagtgaatgctgatctgattggcctttcggggcttatcacgccgtcgctggacgagatggttaacgtggcgaaagagatggagcgtcagggcttcactattccgttactgattggcggcgcgacgacctcaaaagcgcacacggcggtgaaaatcgagcagaactacagcggcccgacggtgtatgtgcagaatgcctcgcgtaccgttggtgtggtggcggcgctgctttccgatacccagcgtgatgattttgtcgctcgtacccgcaaggagtacgaaaccgtacgtattcagcacgggcgcaagaaaccgcgcacaccaccggtcacgctggaagcggcgcgcgataacgatttcgcttttgactggcaggcttacacgccgccggtggcgcaccgtctcggcgtgcaggaagtcgaagccagcatcgaaacgctgcgtaattacatcgactggacaccgttctttatgacctggtcgctggccgggaagtatccgcgcattctggaagatgaagtggtgggcgttgaggcgcagcggctgtttaaagacgccaacgacatgctggataaattaagcgccgagaaaacgctgaatccgcgtggcgtggtgggcctgttcccggcaaaccgtgtgggcgatgacattgaaatctaccgtgacgaaacgcgtacccatgtgatcaacgtcagccaccatctgcgtcaacagaccgaaaaaacaggcttcgctaactactgtctcgctgacttcgttgcgccgaagctttctggtaaagcagattacatcggcgcatttgccgtgactggcgggctggaagaggacgcactggctgatgcctttgaagcgcagcacgatgattacaacaaaatcatggtgaaagcgcttgccgaccgtttagccgaagcctttgcggagtatctccatgagcgtgtgcgtaaagtctactggggctatgcgccgaacgagaacctcagcaacgaagagctgatccgcgaaaactaccagggcatccgtccggcaccgggctatccggcctgcccggaacatacggaaaaagccaccatctgggagctgctggaagtggaaaaacacactggcatgaaactcacagaatctttcgccatgtggcccggtgcatcggtttcgggttggtacttcagccacccggacagcaagtactacgctgtagcacaaattcagcgcgatcaggttgaagattatgcccgccgtaaaggtatgagcgttaccgaagttgagcgctggctggcaccgaatctggggtatgacgcggactga

SEQ ID NO: 311 - DNA, 1155 bp, Escherichia coli
atggcaaaacacctttttacgtccgagtccgtctctgaagggcatcctgacaaaattgctgaccaaatttctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaacaccgttcgcgaaattggctatgtgcattccgacatgggctttgacgctaactcctgtgcggttctgagcgctatcggcaaacagtctcctgacatcaaccagggcgttgaccgtgccgatccgctggaacagggcgcgggtgaccagggtctgatgtttggctacgcaactaatgaaaccgacgtgctgatgccagcacctatcacctatgcacaccgtctggtacagcgtcaggctgaagtgcgtaaaaacggcactctgccgtggctgcgcccggacgcgaaaagccaggtgacttttcagtatgacgacggcaaaatcgttggtatcgatgctgtcgtgctttccactcagcactctgaagagatcgaccagaaatcgctgcaagaagcggtaatggaagagatcatcaagccaattctgcccgctgaatggctgacttctgccaccaaattcttcatcaacccgaccggtcgtttcgttatcggtggcccaatgggtgactgcggtctgactggtcgtaaaattatcgttgatacctacggcggcatggcgcgtcacggtggcggtgcattctctggtaaagatccatcaaaagtggaccgttccgcagcctacgcagcacgttatgtcgcgaaaaacatcgttgctgctggcctggccgatcgttgtgaaattcaggtttcctacgcaatcggcgtggctgaaccgacctccatcatggtagaaactttcggtactgagaaagtgccttctgaacaactgaccctgctggtacgtgagttcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgcgatgctgccggtctgaagtaa

SEQ ID NO: 312 - DNA, 933 bp, Escherichia coli
atggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaa

SEQ ID NO: 313 - DNA, 1287 bp, Escherichia coli
atgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaa

SEQ ID NO: 314 - DNA, 1545 bp, Escherichia coli
atggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttag

SEQ ID NO: 315 - DNA, 1233 bp, Escherichia coli
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaaccaggttgatctggatgcggcggcaaagcgcgggatcccggtatttaacgcaccgttctcaaatacgcgctctgttgcggagctggtgattggcgaactgctgctgctattgcgcggcgtgccggaagccaatgctaaagcgcaccgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaataaactgccgctgggcaacgccactcaggtacagcatctttctgacctgctgaatatgagcgatgtggtgagtctgcatgtaccagagaatccgtccaccaaaaatatgatgggcgcgaaagaaatttcactaatgaagcccggctcgctgctgattaatgcttcgcgcggtactgtggtggatattccggcgctgtgtgatgcgctggcgagcaaacatctggcgggggcggcaatcgacgtattcccgacggaaccggcgaccaatagcgatccatttacctctccgctgtgtgaattcgacaacgtccttctgacgccacacattggcggttcgactcaggaagcgcaggagaatatcggcctggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctgaacaaaatcttcgccgagcagggcgtcaacatcgccgcgcaatatctgcaaacttccgcccagatgggttatgtggttattgatattgaagccgacgaagacgttgccgaaaaagcgctgcaggcaatgaaagctattccgggtaccattcgcgcccgtctgctgtactaa

SEQ ID NO: 316 - DNA, 1089 bp, Escherichia coli
atggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaa

SEQ ID NO: 317 - DNA, 969 bp, Escherichia coli
atgcctaacattacctggtgcgacctgcctgaagatgtctctttatggccgggtctgcctctttcattaagtggtgatgaagtgatgccactggattaccacgcaggtcgtagcggctggctgctgtatggtcgtgggctggataaacaacgtctgacccaataccagagcaaactgggtgcggcgatggtgattgttgccgcctggtgcgtggaagattatcaggtgattcgtctggcaggttcactcaccgcacgggctacacgcctggcccacgaagcgcagctggatgtcgccccgctggggaaaatcccgcacctgcgcacgccgggtttgctggtgatggatatggactccaccgccatccagattgaatgtattgatgaaattgccaaactggccggaacgggcgagatggtggcggaagtaaccgaacgggcgatgcgcggcgaactcgattttaccgccagcctgcgcagccgtgtggcgacgctgaaaggcgctgacgccaatattctgcaacaggtgcgtgaaaatctgccgctgatgccaggcttaacgcaactggtgctcaagctggaaacgctgggctggaaagtggcgattgcctccggcggctttactttctttgctgaatacctgcgcgacaagctgcgcctgaccgccgtggtagccaatgaactggagatcatggacggtaaatttaccggcaatgtgatcggcgacatcgtagacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaggcggaagtcaccatccgtcacgctgacctgatgggggtattctgcatcctctcaggcagcctgaatcagaagtaa

SEQ ID NO: 318 - DNA, 822 bp, Escherichia coli
atgtcgtgtgaagaactggaaattgtctggaacaatattaaagccgaagccagaacgctggcggactgtgagccaatgctggccagtttttaccacgcgacgctactcaagcacgaaaaccttggcagtgcactgagctacatgctggcgaacaagctgtcatcgccaattatgcctgctattgctatccgtgaagtggtggaagaagcctacgccgctgacccggaaatgatcgcctctgcggcctgtgatattcaggcggtgcgtacccgcgacccggcagtcgataaatactcaaccccgttgttatacctgaagggttttcatgccttgcaggcctatcgcatcggtcactggttgtggaatcaggggcgtcgcgcactggcaatctttctgcaaaaccaggtttctgtgacgttccaggtcgatattcacccggcagcaaaaattggtcgcggtatcatgcttgaccacgcgacaggcatcgtcgttggtgaaacggcggtgattgaaaacgacgtatcgattctgcaatctgtgacgcttggcggtacgggtaaatctggtggtgaccgtcacccgaaaattcgtgaaggtgtgatgattggcgcgggcgcgaaaatcctcggcaatattgaagttgggcgcggcgcgaagattggcgcaggttccgtggtgctgcaaccggtgccgccgcataccaccgccgctggcgttccggctcgtattgtcggtaaaccagacagcgataagccatcaatggatatggaccagcatttcaacggtattaaccatacatttgagtatggggatgggatctaa

SEQ ID NO: 319 - DNA, 1254 bp, Escherichia coli
atgttaaagcgtgaaatgaacattgccgattatgatgccgaactgtggcaggctatggagcaggaaaaagtacgtcaggaagagcacatcgaactgatcgcctccgaaaactacaccagcccgcgcgtaatgcaggcgcagggttctcagctgaccaacaaatatgctgaaggttatccgggcaaacgctactacggcggttgcgagtatgttgatatcgttgaacaactggcgatcgatcgtgcgaaagaactgttcggcgctgactacgctaacgtccagccgcactccggctcccaggctaactttgcggtctacaccgcgctgctggaaccaggtgataccgttctgggtatgaacctggcgcatggcggtcacctgactcacggttctccggttaacttctccggtaaactgtacaacatcgttccttacggtatcgatgctaccggtcatatcgactacgccgatctggaaaaacaagccaaagaacacaagccgaaaatgattatcggtggtttctctgcatattccggcgtggtggactgggcgaaaatgcgtgaaatcgctgacagcatcggtgcttacctgttcgttgatatggcgcacgttgcgggcctggttgctgctggcgtctacccgaacccggttcctcatgctcacgttgttactaccaccactcacaaaaccctggcgggtccgcgcggcggcctgatcctggcgaaaggtggtagcgaagagctgtacaaaaaactgaactctgccgttttccctggtggtcagggcggtccgttgatgcacgtaatcgccggtaaagcggttgctctgaaagaagcgatggagcctgagttcaaaacttaccagcagcaggtcgctaaaaacgctaaagcgatggtagaagtgttcctcgagcgcggctacaaagtggtttccggcggcactgataaccacctgttcctggttgatctggttgataaaaacctgaccggtaaagaagcagacgccgctctgggccgtgctaacatcaccgtcaacaaaaacagcgtaccgaacgatccgaagagcccgtttgtgacctccggtattcgtgtaggtactccggcgattacccgtcgcggctttaaagaagccgaagcgaaagaactggctggctggatgtgtgacgtgctggacagcatcaatgatgaagccgttatcgagcgcatcaaaggtaaagttctcgacatctgcgcacgttacccggtttacgcataa

SEQ ID NO: 320 - DNA, 1197 bp, Escherichia coli
atgcgtggagaattttatcagcagttaaccaacgatctggaaaccgcacgggcggaagggttgtttaaagaagagcgcattattacgtctgcgcagcaagcagatatcactgtggctgatggaagccacgtcattaacttttgtgccaacaactatctcgggctggcgaatcatcctgatctgattgcggcggcaaaggcgggaatggattctcacggtttcggcatggcttcggtgcgttttatttgcggcactcaggacagccataaagagcttgaacaaaaactggcggccttcctggggatggaagatgcgattctctactcttcctgctttgatgctaacggtggcctgtttgaaacgcttctgggtgcggaagacgccattatctccgacgcactgaaccacgcgtctattattgatggtgtgcgtctgtgcaaagctaaacgctatcgctatgccaacaacgatatgcaggagctggaagcacgtctgaaagaagcgcgtgaagccggtgcgcgtcatgtgctgatcgccaccgatggtgtgttctcaatggacggcgtgattgccaacctgaagggcgtttgcgatctggcagataaatatgatgccctggtgatggtagacgactcccacgcggtcggttttgtcggtgaaaatggtcgtggttcccatgaatactgcgatgtgatgggccgggtcgatattatcaccggtacgcttggtaaagcgctgggcggggcttctggtggttataccgcggcgcgcaaagaagtggttgagtggctgcgccagcgttctcgtccgtacctgttctccaactcgctggcaccggccattgttgccgcgtccatcaaagtactggagatggtcgaagcgggcagcgaactgcgtgaccgtctgtgggcgaacgcgcgtcagttccgtgagcaaatgtcggcggcgggctttaccctggcgggagccgatcacgccattattccggtcatgcttggtgatgcggtagtggcgcagaaatttgcccgtgagctgcaaaaagagggcatttacgttaccggtttcttctatccggtcgttccgaaaggtcaggcgcgtattcgtacccagatgtctgcggcgcatacccctgagcaaattacgcgtgcagtagaagcatttacgcgtattggtaaacaactgggcgttatcgcctga

SEQ ID NO: 321 - DNA, 1026 bp, Escherichia coli
atgaaagcgttatccaaactgaaagcggaagagggcatctggatgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagatcggcgatcgcgtttctggcgaaggccatatcacctgtggtcattgccgcaactgtcgtggtggtcgtacccatttgtgccgcaacacgataggcgttggtgttaatcgcccgggctgctttgccgaatatctggtgatcccggcattcaacgccttcaaaatccccgacaatatttccgatgacttagccgcaatttttgatcccttcggtaacgccgtgcataccgcgctgtcgtttgatctggtgggcgaagatgtgctggtttctggtgcaggcccgattggtattatggcagcggcggtggcgaaacacgttggtgcacgcaatgtggtgatcactgatgttaacgaataccgccttgagctggcgcgtaaaatgggtatcacccgtgcggttaacgtcgccaaagaaaatctcaatgacgtgatggcggagttaggcatgaccgaaggttttgatgtcggtctggaaatgtccggtgcgccgccagcgtttcgtaccatgcttgacaccatgaatcacggcggccgtattgcgatgctgggtattccgccgtctgatatgtctatcgactggaccaaagtgatctttaaaggcttgttcattaaaggtatttacggtcgtgagatgtttgaaacctggtacaagatggcggcgctgattcagtctggcctcgatctttcgccgatcattacccatcgtttctctatcgatgatttccagaagggctttgacgctatgcgttcgggccagtccgggaaagttattctgagctgggattaa

SEQ ID NO: 322 - DNA, 264 bp, Escherichia coli
atgatgcaacatcaggtcaatgtatcggctcgcttcaatccagaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgccatctgccagagcacaaccacatcacaacaaatccgcgcctga

SEQ ID NO: 323 - DNA, 582 bp, Escherichia coli
ttgttgttaaaacaactgtcggatcgtaaacctgcggattgcgtcgtgaccacagatgtggggcagcaccagatgtgggctgcgcagcacatcgcccacactcgcccggaaaatttcatcacctccagcggtttaggtaccatgggttttggtttaccggcggcggttggcgcacaagtcgcgcgaccgaacgataccgttgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgttttttcaggaacgatacagcgaaaccacccttactgataaccccgatttcctcatgttagccagcgccttcggcatccatggccaacacatcacccggaaagaccaggttgaagcggcactcgacaccatgctgaacagtgatgggccatacctgcttcatgtctcaatcgacgaacttgagaacgtctggccgctggtgccgcctggcgccagtaattcagaaatgttggagaaattatcatga

SEQ ID NO: 324 - DNA, 984 bp, Escherichia coli
atgaatggcgcacagtgggtggtacatgcgttgcgggcacagggtgtgaacaccgttttcggttatccgggtggcgcaattatgccggtttacgatgcattgtatgacggcggcgtggagcacttgctatgccgacatgagcagggtgcggcaatggcggctatcggttatgctcgtgctaccggcaaaactggcgtatgtatcgccacgtctggtccgggcgcaaccaacctgataaccgggcttgcggacgcactgttagattccatccctgttgttgccatcaccggtcaagtgtccgcaccgtttatcggcactgacgcatttcaggaagtggatgtcctgggattgtcgttagcctgtaccaagcacagctttctggtgcagtcgctggaagagttgccgcgcatcatggctgaagcattcgacgttgcctgctcaggtcgtcctggtccggttctggtcgatatcccaaaagatatccagttagccagcggtgacctggaaccgtggttcaccaccgttgaaaacgaagtgactttcccacatgccgaagttgagcaagcgcgccagatgctggcaaaagcgcaaaaaccgatgctgtacgttggcggtggcgtgggtatggcgcaggcagttccggctttgcgtgaatttctcgctgccacaaaaatgcctgccacctgtacgctgaaagggctgggcgcagtagaagcagattatccgtactatctgggcatgctggggatgcacggcaccaaagcggcaaacttcgcggtgcaggagtgtgacctgctgatcgccgtgggcgcacgttttgatgaccgggtgaccggcaaactgaacaccttcgcgccacacgccagtgttatccatatggatatcgacccggcagaaatgaacaagctgcgtcaggcacatgtggcattacaaggtgatttaaatgctctgttaccagcattacagcagccgttaaatcaatga

SEQ ID NO: 325 - DNA, 291 bp, Escherichia coli
atgcaaaacacaactcatgacaacgtaattctggagctcaccgttcgcaaccatccgggcgtaatgacccacgtttgtggcctttttgcccgccgcgcttttaacgttgaaggcattctttgtctgccgattcaggacagcgacaaaagccatatctggctactggtcaatgacgaccagcgtctggagcagatgataagccaaatcgataagctggaagatgtcgtgaaagtgcagcgtaatcagtccgatccgacgatgtttaacaagatcgcggtgttttttcagtaa

SEQ ID NO: 326 - DNA, 1689 bp, Escherichia coli
atggcaagttcgggcacaacatcgacgcgtaagcgctttaccggcgcagaatttatcgttcatttcctggaacagcagggcattaagattgtgacaggcattccgggcggttctatcctgcctgtttacgatgccttaagccaaagcacgcaaatccgccatattctggcccgtcatgaacagggcgcgggctttatcgctcagggaatggcgcgcaccgacggtaaaccggcggtctgtatggcctgtagcggaccgggtgcgactaacctggtgaccgccattgccgatgcgcggctggactccatcccgctgatttgcatcactggtcaggttcccgcctcgatgatcggcaccgacgccttccaggaagtggacacctacggcatctctatccccatcaccaaacacaactatctggtcagacatatcgaagaactcccgcaggtcatgagcgatgccttccgcattgcgcaatcaggccgcccaggcccggtgtggatagacattcctaaggatgtgcaaacggcagtttttgagattgaaacacagcccgctatggcagaaaaagccgccgcccccgcctttagcgaagaaagcattcgtgacgcagcggcgatgattaacgctgccaaacgcccggtgctttatctgggcggcggtgtgatcaatgcgcccgcacgggtgcgtgaactggcggagaaagcgcaactgcctaccaccatgactttaatggcgctgggcatgttgccaaaagcgcatccgttgtcgctgggtatgctggggatgcacggcgtgcgcagcaccaactatattttgcaggaggcggatttgttgatagtgctcggtgcgcgttttgatgaccgggcgattggcaaaaccgagcagttctgtccgaatgccaaaatcattcatgtcgatatcgaccgtgcagagctgggtaaaatcaagcagccgcacgtggcgattcaggcggatgttgatgacgtgctggcgcagttgatcccgctggtggaagcgcaaccgcgtgcagagtggcaccagttggtagcggatttgcagcgtgagtttccgtgtccaatcccgaaagcgtgcgatccgttaagccattacggcctgatcaacgccgttgccgcctgtgtcgatgacaatgcaattatcaccaccgacgttggtcagcatcagatgtggaccgcgcaagcttatccgctcaatcgcccacgccagtggctgacctccggtgggctgggcacgatgggttttggcctgcctgcggcgattggcgctgcgctggcgaacccggatcgcaaagtgttgtgtttctccggcgacggcagcctgatgatgaatattcaggagatggcgaccgccagtgaaaatcagctggatgtcaaaatcattctgatgaacaacgaagcgctggggctggtgcatcagcaacagagtctgttctacgagcaaggcgtttttgccgccacctatccgggcaaaatcaactttatgcagattgccgccggattcggcctcgaaacctgtgatttgaataacgaagccgatccgcaggcttcattgcaggaaatcatcaatcgccctggcccggcgctgatccatgtgcgcattgatgccgaagaaaaagtttacccgatggtgccgccaggtgcggcgaatactgaaatggtgggggaataa

SEQ ID NO: 327 - DNA, 492 bp, Escherichia coli
atgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttgatgcatttttagcatcgattcgcgatgtggcgaaaattgtggaggttgctcgctctggtgtggtcggactttcgcgcggcgataaaataatgcgttga

SEQ ID NO: 328 - DNA, 99 bp, Escherichia coli
atgacagcccttctacgagtgattagcctggtcgtgattagcgtggtggtgattattatcccaccgtgcggggctgcacttggacgaggaaaggcttag

SEQ ID NO: 329 - DNA, 1476 bp, Escherichia coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 330 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 331 - DNA, 930 bp, Escherichia coli
atgaccacgaagaaagctgattacatttggttcaatggggagatggttcgctgggaagacgcgaaggtgcatgtgatgtcgcacgcgctgcactatggcacttcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataa

SEQ ID NO: 332 - DNA, 1344 bp, Escherichia coli
atggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaa

SEQ ID NO: 333 - DNA, 1410 bp, Escherichia coli
atgtccgctgaacacgtactgacgatgctgaacgagcacgaagtgaagtttgttgatttgcgcttcaccgatactaaaggtaaagaacagcacgtcactatccctgctcatcaggtgaatgctgaattcttcgaagaaggcaaaatgtttgacggctcctcgattggcggctggaaaggcattaacgagtccgacatggtgctgatgccagacgcatccaccgcagtgattgacccgttcttcgccgactccaccctgattatccgttgcgacatccttgaacctggcaccctgcaaggctatgaccgtgacccgcgctccattgcgaagcgcgccgaagattacctgcgttccactggcattgccgacaccgtactgttcgggccagaacctgaattcttcctgttcgatgacatccgtttcggatcatctatctccggttcccacgttgctatcgacgatatcgaaggcgcatggaactcctccacccaatacgaaggtggtaacaaaggtcaccgtccggcagtgaaaggcggttacttcccggttccaccggtagactcggctcaggatattcgttctgaaatgtgtctggtgatggaacagatgggtctggtggttgaagcccatcaccacgaagtagcgactgctggtcagaacgaagtggctacccgcttcaataccatgaccaaaaaagctgacgaaattcagatctacaaatatgttgtgcacaacgtagcgcaccgcttcggtaaaaccgcgacctttatgccaaaaccgatgttcggtgataacggctccggtatgcactgccacatgtctctgtctaaaaacggcgttaacctgttcgcaggcgacaaatacgcaggtctgtctgagcaggcgctgtactacattggcggcgtaatcaaacacgctaaagcgattaacgccctggcaaacccgaccaccaactcttataagcgtctggtcccgggctatgaagcaccggtaatgctggcttactctgcgcgtaaccgttctgcgtctatccgtattccggtggtttcttctccgaaagcacgtcgtatcgaagtacgtttcccggatccggcagctaacccgtacctgtgctttgctgccctgctgatggccggtcttgatggtatcaagaacaagatccatccgggcgaagccatggacaaaaacctgtatgacctgccgccagaagaagcgaaagagatcccacaggttgcaggctctctggaagaagcactgaacgaactggatctggaccgcgagttcctgaaagccggtggcgtgttcactgacgaagcaattgatgcgtacatcgctctgcgtcgcgaagaagatgaccgcgtgcgtatgactccgcatccggtagagtttgagctgtactacagcgtctaa

SEQ ID NO: 334 - DNA, 1149 bp, Escherichia coli
ttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcaccaatgacgccgatgaagaatcttctcaggtacatgcacaaggtctggtgattcgcgacctgccgctgattgccagcaacttccgtaataccgaagacctctcttcttacctgaaacgccataacatcgtggcgattgccgatatcgatacccgtaagctgacgcgtttactgcgcgagaaaggcgcacagaatggctgcattatcgcgggcgataacccggatgcggcgctggcgttagaaaaagcccgcgcgttcccaggtctgaatggcatggatctggcaaaagaagtgaccaccgcagaagcctatagctggacacaagggagctggacgttgaccggtggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgtctcggtcatcagctgctggcgctggcgagcggtgcgaagactgtcaaaatgaaatttggtcaccacggcggcaaccatccggttaaagatgtggagaaaaacgtggtaatgatcaccgcccagaaccacggttttgcggtggacgaagcaacattacctgcaaacctgcgtgtcacgcataaatccctgttcgacggtacgttacagggcattcatcgcaccgataaaccggcattcagcttccaggggcaccctgaagccagccctggtccacacgacgccgcgccgttgttcgaccactttatcgagttaattgagcagtaccgtaaaaccgctaagtaa

SEQ ID NO: 335 - DNA, 3222 bp, Escherichia coli
atgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgcaacctacatcgagccgattcactgggaagttgtacgcaagattattgaaaaagagcgcccggacgcggtgctgccaacgatgggcggtcagacggcgctgaactgcgcgctggagctggaacgtcagggcgtgttggaagagttcggtgtcaccatgattggtgccactgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgtgaagagtttgaagaaatttgcgcccgcggtctggatctctctccgaccaaagagttgctgattgatgagtcgctgatcggctggaaagagtacgagatggaagtggtgcgtgataaaaacgacaactgcatcatcgtctgctctatcgaaaacttcgatgcgatgggcatccacaccggtgactccatcactgtcgcgccagcccaaacgctgaccgacaaagaatatcaaatcatgcgtaacgcctcgatggcggtgctgcgtgaaatcggcgttgaaaccggtggttccaacgttcagtttgcggtgaacccgaaaaacggtcgtctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgccggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctggatgacccggaagcgttaaccaaaatccgtcgcgaactgaaagacgcaggcgcagatcgtatctggtacatcgccgatgcgttccgtgcgggcctgtctgtggacggcgtcttcaacctgaccaacattgaccgctggttcctggtacagattgaagagctggtgcgtctggaagagaaagtggcggaagtgggcatcactggcctgaacgctgacttcctgcgccagctgaaacgcaaaggctttgccgatgcgcgcttggcaaaactggcgggcgtacgcgaagcggaaatccgtaagctgcgtgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggtgcttggcggcggcccgaaccgtatcggtcagggtatcgaattcgactactgttgcgtacacgcctcgctggcgctgcgcgaagacggttacgaaaccattatggttaactgtaacccggaaaccgtctccaccgactacgacacttccgaccgcctctacttcgagccggtaactctggaagatgtgctggaaatcgtgcgtatcgagaagccgaaaggcgttatcgtccagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggaccacttcctcgatgacgcggtagaagttgacgtggatgccatctgcgacggcgaaatggtgctgattggcggcatcatggagcatattgagcaggcgggcgtgcactccggtgactccgcatgttctctgccagcctacaccttaagtcaggaaattcaggatgtgatgcgccagcaggtgcagaaactggccttcgaattgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgcgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtcatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcaggtatcaacccgcgtctggtaaacaaggtgcatgaaggccgtccgcacattcaggaccgtatcaagaatggcgaatatacctacatcatcaacaccacctcaggccgtcgtgcgattgaagactcccgcgtgattcgtcgcagtgcgctgcaatataaagtgcattacgacaccaccctgaacggcggctttgccaccgcgatggcgctgaatgccgatgcgactgaaaaagtaatttcggtgcaggaaatgcacgcacagatcaaataa

SEQ ID NO: 336 - DNA, 471 bp, Escherichia coli
atgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctga

SEQ ID NO: 337 - DNA, 660 bp, Escherichia coli
gtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaa

SEQ ID NO: 338 - DNA, 1332 bp, Escherichia coli
gtggtaaaggaacgtaaaaccgagttggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcgcatcaccacgaaccgctgtatcacaagaatatacgtgtgaccgacgccaaaacactggaactggtgaagcaggctgcgggaacattgcaactggatattactgctcgcctgtcgatgagtctcaataacacgccgctgcagggcgcgcatatcaacgtcgtcagtggcaattttattattgcccagccgctgggcgtcgatgacggcgtggattactgccatagcgggcgtatccggcggattgatgaagacgcgatccatcgtcaactggacagcggtgcaatagtgctaatggggccggtcgctgtttcagtcactggcgagagctttaacctgacctcggaagagattgccactcaactggccatcaaactgaaagctgaaaagatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccactggagcagcaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcaaggggtgaagttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttagggtaa

SEQ ID NO: 339 - DNA, 777 bp, Escherichia coli
atgatgaatccattaattatcaaactgggcggcgtactgctggatagtgaagaggcgctggaacgtctgtttagcgcactggtgaattatcgtgagtcacatcagcgtccgctggtgattgtgcacggcggcggttgcgtggtggatgagctgatgaaagggctgaatctgccggtgaaaaagaaaaacggcctgcgggtgacgcctgctgatcagatagacattatcaccggagcactggcgggaacggcaaataaaaccctgttggcatgggcgaagaaacatcagattgcggccgtaggtttgtttctcggtgacggcgacagcgtcaaagtgacccagcttgatgaagagttaggtcatgttggactggcgcagccaggttcgcctaagcttatcaactccttgctggagaacggttatctgccggtggtcagctccattggcgtaacagacgaagggcaactgatgaacgtcaatgccgaccaggcggcaacggcgctggcggcaacgctgggcgcggatctgattttgctctccgacgtcagcggcattctcgacggcaaagggcaacgcattgccgaaatgaccgccgcgaaagcagaacaactgattgagcagggcattattactgacggcatgatagtgaaagtgaacgcggcgctggatgcggcccgcacgctgggccgtccggtagatatcgcctcctggcgtcatgcggagcagcttccggcactgtttaacggtatgccgatgggtacgcggattttagcttaa

SEQ ID NO: 340 - DNA, 1005 bp, Escherichia coli
atgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtagtgtttctcgccaccgcccatgaagttagccacgatttagcgccgcagtttcttgaagcgggctgcgtggtgttcgacctttccggcgcgtttcgtgttaacgacgccaccttctatgaaaaatattacggctttacccatcaatacccggaactgttggaacaggcagcctacggtctggcggagtggtgcggtaataaattaaaagaagcgaatttgattgcggtgccgggctgttatccgacggcggcacagctggcgctgaaaccgttgattgatgccgatcttcttgacctcaatcagtggccggtgatcaacgccaccagcggcgtgagcggtgcagggcgtaaagcggccatttcaaacagcttttgtgaagttagcctgcaaccgtatggcgtctttactcatcgccatcaaccagagatcgccacacacctcggtgctgacgttatcttcaccccacatctgggcaatttcccgcgcggcattctcgaaaccattacctgccgcctgaaatcgggtgtgacccaggcgcaagtcgcgcaagtgttacagcaggcgtatgcccataaaccgctggtgcggctgtatgacaaaggcgttccggcgctgaaaaatgtcgttgggctgccattttgcgatatcgggtttgccgttcagggcgagcatctgattattgtggcgaccgaagacaacttactgaaaggcgcggcggcacaagcggtacagtgcgccaatattcgtttcggctatgcggaaacgcagtctcttatttaa

SEQ ID NO: 341 - DNA, 1221 bp, Escherichia coli
atgtctcagccaattacgcgtgaaaactttgatgaatggatgatacctgtttacgctccggcaccctttataccggtacgtggcgaaggttcgcgcttgtgggatcagcaggggaaagagtatatcgacttcgcgggtggcattgcggtgaacgcgctgggccatgcgcatccggaactgcgtgaagcgctgaacgaacaggcgagtaagttctggcataccggcaacggttacaccaacgagccggtactgcgactggcgaaaaaattgatcgacgccacgtttgccgatcgcgtcttcttttgtaactccggtgcggaagccaacgaagcggcgctaaaactggcgcgtaaattcgctcacgaccgctacggcagccataagagcggcatcgtggcgttcaaaaatgcgtttcatggtcgcacgctgtttactgtcagtgcgggtgggcagccagcctattcacaggattttgcgccactgccggcggatattcgtcatgctgcatataacgatattaactctgccagcgcgctgattgacgactctacctgtgcggtgattgtcgaacccatccagggggaaggcggtgtggtgccagccagcaacgcgtttttacaaggtctgcgtgaattgtgtaaccgccacaatgcgctgttgatttttgatgaagtacaaaccggcgtcgggcgcaccggggaactgtatgcctatatgcactacggcgtgacgcctgatctgttaactaccgccaaagcgctgggcggcggtttcccggtcggtgcgttgttggcaaccgaagagtgcgcccgcgtgatgaccgttggcactcatggcaccacctatggcggtaatccgctggcctcggcggtggcaggcaaagtgctggagctcatcaacacaccagagatgcttaatggcgttaaacagcgtcacgactggtttgttgagcgtcttaatactattaatcaccgctatggtttgttcagtgaagttcgcggcttaggtttgctgattggctgtgtactgaatgccgattacgccgggcaagcgaaacagatctctcaggaagcggcgaaagcaggcgtgatggtactgattgcgggtggcaacgtggtgcgttttgcgcctgcgctcaatgtcagcgaagaagaggtgacgaccggactggatcgctttgcagctgcttgcgaacactttgttagccgaggttcatcatga

SEQ ID NO: 342 - DNA, 1221 bp, Escherichia coli
atggcaattgaacaaacagcaattacacgcgcgactttcgatgaagtgatcctgccgatttatgctccggcagagtttattccggtaaaaggtcagggcagccgaatctgggatcagcaaggcaaggagtatgtcgatttcgcgggtggcattgcagttacggcgttgggccattgccatcctgcgctggtgaacgcgttaaaaacccagggcgaaactctgtggcatatcagtaacgttttcaccaatgaaccggcgctgcgtcttgggcgtaaactgattgaggcaacgtttgccgaacgcgtggtgtttatgaactccggcacggaagctaacgaaaccgcctttaaactggcacgccattacgcctgtgtgcgtcatagcccgttcaaaaccaaaattattgccttccataacgcttttcatggtcgctcgctgtttaccgtttcggtgggtgggcagccaaaatattccgacggctttgggccgaaaccggcagacatcatccacgttccctttaacgatctccatgcagtgaaagcggtgatggatgatcacacctgtgcggtggtggttgagccgatccagggcgagggcggtgtgacggcagcgacgccagagtttttgcagggcttgcgcgagctgtgcgatcaacatcaggcattattggtgtttgatgaagtgcagtgcgggatggggcggaccggcgatttgtttgcttacatgcactacggcgttacgccggatattctgacctctgcgaaagcgttaggcggcggcttcccgattagcgccatgctgaccacggcggaaattgcttctgcgtttcatcctggttctcacggttccacctacggcggtaatcctctggcctgtgcagtagcgggggcggcgtttgatatcatcaatacccctgaagtgctggaaggcattcaggcgaaacgccagcgttttgttgaccatctgcagaagatcgatcagcagtacgatgtatttagcgatattcgcggtatggggctgttgattggcgcagagctgaaaccacagtacaaaggtcgggcgcgtgatttcctgtatgcgggcgcagaggctggcgtaatggtgctgaatgccggaccggatgtgatgcgttttgcaccgtcgctggtggtggaagatgcggatatcgatgaagggatgcaacgtttcgcccacgcggtggcgaaggtggttggggcgtaa

SEQ ID NO: 343 - DNA, 1152 bp, Escherichia coli
atgaaaaacaaattaccgccatttatcgagatttaccgcgctctgattgccacaccttcaataagcgccacggaagaggcactcgatcaaagcaatgcagatttaatcactctgctggcggactggtttaaagatttgggcttcaatgtggaagtgcagcctgttccaggaactcgcaacaaattcaatatgctggcaagtatcggacagggggctggcggcttgttgctggcggggcataccgatacggtgccatttgatgacggtcgctggacgcgcgatccgtttacactgacggagcatgacggcaagctttacggcttaggcaccgccgacatgaaaggcttttttgcgtttatccttgatgcgctacgcgatgtcgacgtcacgaaactgaaaaaaccgctctacattctggcgactgctgatgaagaaaccagtatggccggagcgcgttattttgccgaaactaccgccctgcgcccggattgcgccatcattggcgaaccgacgtcactacaaccggtacgcgcacataaaggtcatatctctaacgccatccgtattcagggccagtcggggcactccagcgatccagcacgcggagttaacgctatcgaactaatgcacgacgccatcgggcatattttgcaattgcgcgataacctgaaagaacgttatcactacgaagcgtttaccgtgccataccctacgctcaacctcgggcatattcacggtggcgacgcttctaaccgtatttgcgcttgctgtgagttgcatatggatattcgtccgctgcctggcatgacactcaatgaacttaatggtttgctcaacgatgcattggctccggtgagcgaacgctggccgggtcgtctgacggtcgacgagctgcatccgccgatccctggctatgaatgcccaccgaatcatcaactggttgaagtggttgagaaattgctcggagcaaaaaccgaagtggtgaactactgtaccgaagcgccgtttattcaaacgttatgcccgacgctggtgttggggcctggctcaattaatcaggctcatcaacctgatgaatatctggaaacacggtttatcaagcccacccgcgaactgataacccaggtaattcaccatttttgctggcattaa

SEQ ID NO: 344 - DNA, 1005 bp, Escherichia coli
atgtccgatttatacaaaaaacactttctgaaactgctcgactttacccctgcacagttcacttctctgctgacccttgccgcacagctcaaagccgataaaaaaaatggcaaggaagtacagaagcttaccggtaaaaacatcgcgctcatcttcgaaaaagactcgactcgtacccgttgctctttcgaagttgccgcatttgaccagggcgcgcgcgttacctatttagggccgagcggcagccagattgggcataaagagtcaattaaggacaccgcgcgggttctcgggcggatgtatgacggcattcagtatcgcggtcacggccaggaagtggtcgaaacgctggcgcagtatgcgggcgtgccggtgtggaacgggctgaccaacgagttccacccgacccagctgctggcggacctgatgaccatgcaggagcacctgccgggcaaggcgtttaacgagatgacgctggtctacgcgggcgatgcgcgcaacaacatgggcaactcgatgctggaagcggcggcgctgaccgggctggatctgcgcctgttggccccgaaagcctgctggccggaagagagcctggtggcggagtgcagcgcgctggcggagaagcacggcgggaaaattactctgacggaagacgtggcggcaggcgttaagggcgcggactttatctataccgacgtgtgggtgtcgatgggcgaggccaaagagaagtgggcagagcggattgcgctgctgcgcgggtatcaggtgaacgcgcagatgatggcgctgaccgacaacccgaacgtgaagttcctgcactgtctgccggcgttccatgacgaccagactacgctcggcaagcagatggcgaaggagttcgatctgcacggcgggatggaggtgacggacgaggtgtttgagtcggcggcgagcatcgtgttcgaccaggcggaaaaccggatgcatacgattaaggcggtgatgatggcaacgcttggggagtga

SEQ ID NO: 345 - DNA, 1005 bp, Escherichia coli
atgtccgggttttatcataagcatttcctgaaattactcgatttcacgccagctgaactcaacagcctgctgcagttagccgcgaagctgaaagccgataagaaaagcggtaaagaagaagccaaactcactggtaaaaacatcgcgctcatcttcgaaaaagactcgactcgtacccgatgctctttcgaagttgccgcatatgaccagggtgctcgcgttacttatctcggcccaagcggcagccagattggtcataaagagtcgattaaagacactgcccgcgtgcttggtcgcatgtatgacggtattcagtatcgcggctatggtcaggagattgtcgaaacactggcggaatacgctagcgtgccggtatggaatggcctgaccaatgagttccatcccacgcagctgctggcggatcttctcaccatgcaggagcatttgcccggcaaagcgttcaacgaaatgacgctggtctatgcaggtgacgcgcgtaacaacatgggcaattcgatgctcgaagctgcggcgcttaccggtctggatttgcgtctggtcgcgccacaagcgtgctggccggaagctgcgctggttacggaatgccgcgccctggcacagcaaaatggtgggaatattacgctgactgaagatgtcgcgaagggagttgaaggtgctgactttatctataccgatgtgtgggtgtcgatgggggaagcaaaagagaaatgggcggaacggattgcattgctgcgtgaatatcaggtgaacagcaagatgatgcagttgaccggtaacccggaggtcaaattcctccactgcctgcccgcgtttcatgacgaccaaacgacgcttggcaagaaaatggcggaagaatttggcctacatggcggtatggaagtcactgatgaggtcttcgaatctgccgccagcattgtttttgatcaggcggaaaaccgtatgcatactatcaaagcggtgatggtcgcgacgctcagtaaataa

SEQ ID NO: 346 - DNA, 1344 bp, Escherichia coli
atgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctacaaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgaacaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaa

SEQ ID NO: 347 - DNA, 1374 bp, Escherichia coli
atggcactttggggcgggcgttttacccaggcagcagatcaacggttcaaacaattcaacgactcactgcgctttgattaccgtctggcggagcaggatattgttggctctgtggcctggtccaaagccctggtcacggtaggcgtgttaaccgcagaagagcaggcgcaactggaagaggcgctgaacgtgttgctggaagatgttcgcgccaggccacaacaaatccttgaaagcgacgccgaagatatccatagctgggtggaaggcaaactgatcgacaaagtgggccagttaggcaaaaagctgcataccgggcgtagccgtaatgatcaggtagcgactgacctgaaactgtggtgcaaagataccgttagcgagttactgacggctaaccggcagctgcaatcggcgctggtggaaaccgcacaaaacaatcaggacgcggtaatgccaggttacactcacctgcaacgcgcccagccggtgacgttcgcgcactggtgcctggcctatgttgagatgctggcgcgtgatgaaagccgtttgcaggatgcgcttaagcgtctggatgtcagcccgctaggctgtggcgcgctggcgggaacggcctatgaaatcgaccgtgaacagttagcaggctggctgggctttgcttcggcgacccgtaacagtctcgacagcgtttctgaccgtgaccatgtgttggaactgctttctgctgccgctatcggcatggtgcatctgtcgcgttttgctgaagatctgattttctttaacaccggcgaagcggggtttgtggagctttctgaccgcgtgacttccggttcatcattaatgccgcagaagaaaaacccggatgcgctggagctgattcgcggtaaatgcggccgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccacgttgccaggaagcggctcagcagggttacgccaacgccaccgaactggcggattatctggtggcgaaaggcgtaccgttccgcgaggcgcaccatattgttggtgaagcggtggtggaagccattcgtcagggcaaaccgctggaagatctgccgctcagtgagttgcagaaattcagtcaggtgattgacgaagatgtctatccgattctgtcgctgcaatcgtgcctcgacaagcgtgcggcaaaaggcggcgtctcaccgcagcaggtggcgcaggcgattgcttttgcgcaggctcggttagggtaa

SEQ ID NO: 348 - DNA, 1977 bp, Escherichia coli
atgtctgacgacatgtctatgggtttgccttcgtcagcgggcgaacacggtgtactacgctccatgcaggaggttgcaatgagctcccaggaagccagcaagatgctgcgtacttacaatattgcctggtggggcaataactactatgacgttaacgagctgggccacattagcgtgtgcccggacccggacgtcccggaagctcgcgtcgatctcgcgcagttagtgaaaactcgtgaagcacagggccagcgtctgcctgcactgttctgtttcccacagatcctgcagcaccgtttgcgttccattaacgccgcgttcaaacgtgcgagggaatcctacggctataacggcgattacttccttgtttatccgatcaaagttaaccagcaccgccgcgtgattgagtccctgattcattcgggcgaaccgctgggtctggaagccggttccaaagccgagttgatggcagtactggcacatgctggcatgacccgtagcgtcatcgtctgcaacggttataaagaccgcgaatatatccgcctggcattaattggcgagaagatggggcacaaggtctatctggtcattgagaagatgtcagaaatcgccattgtgctggatgaagcagaacgtctgaatgtcgttcctcgtctgggcgtgcgtgcacgtctggcttcgcagggttcgggtaaatggcagtcctccggcggggaaaaatcgaagttcggcctggctgcgactcaggtactgcaactggttgaaaccctgcgtgaagccgggcgtctcgacagcctgcaactactgcacttccacctcggttcgcagatggcgaatattcgcgatatcgcgacaggcgttcgtgaatccgcgcgtttctatgtggaactgcacaagctgggcgtcaatattcagtgcttcgacgtcggcggcggtctgggcgtggattatgaaggtactcgttcgcagtccgactgttcggtgaactacggcctcaatgaatacgccaacaacattatctgggcgattggcgatgcgtgtgaagaaaacggtctgccgcatccgacggtaatcaccgaatcgggtcgtgcggtgactgcgcatcacaccgtgctggtgtctaatatcatcggcgtggaacgtaacgaatacacggtgccgaccgcgcctgcagaagatgcgccgcgcgcgctgcaaagcatgtgggaaacctggcaggagatgcacgaaccgggaactcgccgttctctgcgtgaatggttacacgacagtcagatggatctgcacgacattcatatcggctactcttccggcatctttagcctgcaagaacgtgcatgggctgagcagctttatttgagcatgtgccatgaagtgcaaaagcagctggatccgcaaaaccgtgctcatcgtccgattatcgacgagctgcaggaacgtatggcggacaaaatgtacgtcaacttctcgctgttccagtcgatgccggacgcatgggggatcgaccagttgttcccggttctgccgctggaagggctggatcaagtgccggaacgtcgcgctgtgctgctggatattacctgtgactctgacggtgctatcgaccactatattgatggtgacggtattgccacgacaatgccaatgccggagtacgatccagagaatccgccgatgctcggtttctttatggtcggcgcatatcaggagatcctcggcaacatgcacaacctgttcggtgataccgaagcggttgacgtgttcgtcttccctgacggtagcgtagaagtagaactgtctgacgaaggcgataccgtggcggacatgctgcaatatgtacagctcgatccgaaaacgctgttaacccagttccgcgatcaagtgaagaaaaccgatcttgatgctgaactgcaacaacagttccttgaagagttcgaggcaggtttgtacggttatacttatcttgaagatgagtaa

SEQ ID NO: 349 - DNA, 2268 bp, Escherichia coli
atgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcagaagaaaatcagtgaaagcccgctgaccaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtacctacccgcaccactgacttccaaattatgttcctgttctctatgggcgtaacccgtgggaaatggggaactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaagtcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgcgtgaaagcgtaa

SEQ ID NO: 350 - DNA, 921 bp, Escherichia coli
atgagcaccttaggtcatcaatacgataactcactggtttccaatgcctttggttttttacgcctgccgatgaacttccagccgtatgacagcgatgcagactgggtgattactggcgtgccgttcgatatggccacttctggtcgtgcgggtggtcgccacggtccggcagcgatccgtcaggtttcgacgaatctggcctgggaacacaaccgcttcccgtggaatttcgacatgcgtgagcgtctgaacgtcgtggactgcggcgatctggtatatgcctttggcgatgcccgtgagatgagcgaaaagctgcaggcgcacgccgagaagctgctggctgccggtaagcgtatgctctctttcggtggtgaccactttgttacgctgccgctgctgcgtgctcatgcgaagcatttcggcaaaatggcgctggtacactttgacgcccacaccgatacctatgcgaacggttgtgaatttgaccacggcactatgttctataccgcgccgaaagaaggtctgatcgacccgaatcattccgtgcagattggtattcgtaccgagtttgataaagacaacggctttaccgtgctggacgcctgccaggtgaacgatcgcagcgtggatgacgttatcgcccaagtgaaacagattgtgggtgatatgccggtttacctgacttttgatatcgactgcctggatcctgcttttgcaccaggcaccggtacgccagtgattggcggcctgacctccgatcgcgctattaaactggtacgcggcctgaaagatctcaacattgttgggatggacgtagtggaagtggctccggcatacgatcagtcggaaatcactgctctggcagcggcaacgctggcgctggaaatgctgtatattcaggcggcgaaaaagggcgagtaa

SEQ ID NO: 351 - DNA, 1380 bp, Escherichia coli
ttgaacaggttaccttcgagcgcatcggctttagcgtgcagcgcccacgccctgaatctcattgagaagcgaacgctggatcatgaggagatgaaagcacttaaccgagaggtgattgaatacttcaaagagcatgtcaatccggggtttttagagtatcgcaaatctgttaccgccggcggggattacggagccgtagagtggcaagcgggaagtttaaatacgcttgtcgacacccagggccaggagtttatcgactgcctgggaggttttggaattttcaacgtggggcaccgtaatccagttgtggtttccgccgtacagaatcaacttgcgaaacaaccgctgcacagccaggagctgctcgatccgttacgggcgatgttggcgaaaacccttgctgcgctaacgcccggtaaactgaaatacagcttcttctgtaatagcggcaccgagtccgttgaagcagcgctgaagctggcgaaagcttaccagtcaccgcgcggcaagtttacttttattgccaccagcggcgcgttccacggtaaatcacttggcgcgctgtcggccacggcgaaatcgaccttccgcaaaccgtttatgccgttactgccgggcttccgtcatgtgccgtttggcaatatcgaagccatgcgcacggctcttaacgagtgcaaaaaaaccggtgatgatgtggctgcggtgatcctcgaaccgattcagggtgaaggtggcgtaattctgccgccgccgggctatctcaccgccgtacgtaagctatgcgatgagttcggcgcactgatgatcctcgatgaagtacaaacgggcatggggcgcacgggcaagatgttcgcctgcgagcatgagaacgtacagccggatatcctctgccttgccaaagcgctcggcggcggcgtgatgccgattggcgcgaccatcgccactgaagaggtgttttcagttctgttcgacaacccattcctgcataccaccacctttggcggcaacccgctggcctgtgcggcggcgctggcgaccatcaatgtgttgctggagcagaacttaccggctcaggctgagcaaaaaggcgatatgttgctggacggtttccgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacgctcaataacgccaaaacgatccgcattgaaccgccactgacactgaccattgaacagtgtgaactggtgatcaaagcggcgcgtaaggcgctggcggccatgcgagtaagtgtcgaagaagcgtaa

SEQ ID NO: 352 - DNA, 2136 bp, Escherichia coli
atgaaatcaatgaatattgccgccagtagtgaactggtatcccgactttcttctcatcgtcgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttttttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcgggggcgacgccggtctatctggaagcttcacgcaacccgtttggtttcattggcggtattgatgcgcactgttttaatgaagagtatctgcgccagcaaattcgcgacgttgcgccagaaaaagccgacctgccgcgcccgtatcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgtgttgagatagggattgaagcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaactccattctgtttttattaactccggcggaaagccacgagaagctggcacaactggtggcgatgctggcgcaatttgaacagcatattgaggatgactcgccgctggttgaggtgttgccgagcgtttataacaagtatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcgtgaaacggttgtacggttatgtgttgaagtaa

SEQ ID NO: 353 - DNA, 2199 bp, Escherichia coli
atgtcaaaattaaaaattgcggttagtgattcttgcccggactgttttaccacgcagcgagaatgtatctacattaatgaaagtcgtaatatcgatgtggcggcaatagttttatcgctcaacgatgttacatgcggaaaactcgatgaaatcgatgccacgggttatggcatcccggtatttattgctactgaaaatcaagaacgtgtacccgcagagtatttgccccgtatttcgggtgtctttgagaattgcgaatcgcgacgagaattttatggtcgccagttagaaaccgctgccagccattatgaaactcaactgcgcccacctttcttccgcgcactggtcgattatgtcaatcaaggtaacagcgcgtttgattgccctggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcggcaaaagtgtttaatgccgataaaacctacttcgttttaaatggcacttcatcttctaacaaagtggttttaaacgccctgctaacaccgggtgatctggtgctgtttgatcgcaataaccacaaatctaaccaccacggagcgttgctacaggctggtgcaacaccggtttatctggaaacggcacgtaacccgtatggctttatcggtggcattgatgcgcactgttttgaagaaagttacctgcgtgagctgatcgcggaagtcgcaccgcagcgggcaaaagaggctcgtcctttccgcctcgctgtgattcagttaggcacctacgacggtacgatttataacgcccgccaagtggtggataaaattggtcatctgtgtgactacatcctgtttgactcagcatgggtcggctatgaacagtttattccgatgatggcggactgttcgccgctgttgctggatcttaatgagaacgatccgggtattctggttacgcaatctgtgcataaacaacaggctggtttttctcagacttcacaaattcataaaaaagacagccacatcaaagggcaacagcgttatgtaccgcacaaacgcatgaacaacgcctttatgatgcacgcctccaccagcccgttctatccgctgtttgccgcactgaatatcaacgccaaaatgcatgaaggtgtcagcggtcgtaatatgtggatggattgtgtggtaaatggcattaatgcccgcaaactgatcctcgataactgtcagcatattcgtccgttcgtacctgaactggtggatggtaaaccctggcagtcgtatgaaacagcgcaaattgcggttgatctgcgcttcttccagtttgtaccaggggaacactggcattcttttgaaggctatgcagagaatcaatactttgtcgatccatgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgcttgagtccgacgcgccattagcagaagtgctaccttccatctacaaacagcatgaagagcgctacgccggttataccctgcgtcagttgtgtcaggaaatgcatgatttgtatgcccgccacaacgtgaaacaactgcaaaaagagatgttccgtaaggagcacttcccacgcgtcagcatgaatccgcaagaagccaactacgcctatttacgcggtgaagtggaactggttcgtctgccggatgcagaaggccgtatcgctgccgaaggtgcgcttccttatcctccgggtgtgctgtgtgttgttccgggtgaaatctggggtggtgctgttctgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatga

SEQ ID NO: 354 - DNA, 1266 bp, Escherichia coli
atgagcaacaatgaattccatcagcgtcgtctttctgccactccgcgcggggttggcgtgatgtgtaacttcttcgcccagtcggctgaaaacgccacgctgaaggatgttgagggcaacgagtacatcgatttcgccgcaggcattgcggtgctgaataccggacatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcaccaccggtgcggaagcggtggaaaacgcggtgaaaattgctcgcgcccataccggacgccctggcgtgattgcgtttagcggcggctttcacggtcgtacgtatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtggcggcgattattttcgaaccggtgcagggcgagggcggtttcaacgttgcgccaaaagagctggttgccgctattcgccgcctgtgcgacgagcacggtattgtgatgattgctgatgaagtgcaaagcggctttgcgcgtaccggtaagctgtttgccatggatcattacgccgataagccggatttaatgacgatggcgaaaagcctcgcgggcgggatgccgctttcgggcgtggtcggtaacgcgaatattatggacgcacccgcgccgggcgggcttggcggcacctacgccggtaacccgctggcggtggctgccgcgcacgcggtgctcaacattatcgacaaagaatcactctgcgaacgcgcgaatcaactgggccagcgtctcaaaaacacgttgattgatgccaaagaaagcgttccggccattgctgcggtacgcggcctggggtcgatgattgcggtagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaa

SEQ ID NO: 355 - DNA, 1281 bp, Escherichia coli
atgaacagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaggtggtggccgcggtggaagcgcagttgaaaaaactgtcgcacacctgcttccaggtgctggcttacgagccgtatctggagctgtgcgagattatgaatcagaaggtgccgggcgatttcgccaagaaaacgctgctggttacgaccggttccgaagcggtggaaaacgcggtaaaaatcgcccgcgccgccaccaaacgtagcggcaccatcgcttttagcggcgcgtatcacgggcgcacgcattacacgctggcgctgaccggcaaggtgaatccgtactctgcgggcatggggctgatgccgggtcatgtttatcgcgcgctttatccttgcccgctgcacggcataagcgaggatgacgctatcgccagcatccaccggatcttcaaaaatgatgccgcgccggaagatatcgccgccatcgtgattgagccggttcagggcgaaggcggtttctacgcctcgtcgccagcctttatgcagcgtttacgcgctctgtgtgacgagcacgggatcatgctgattgccgatgaagtgcagagcggcgcggggcgtaccggcacgctgtttgcgatggagcagatgggcgttgcgccggatcttaccacctttgcgaaatcgatcgcgggcggcttcccgctggcgggcgtcaccgggcgcgcggaagtaatggatgccgtcgctccaggcggtctgggcggcacctatgcgggtaacccgattgcctgcgtggctgcgctggaagtgttgaaggtgtttgagcaggaaaatctgctgcaaaaagccaacgatctggggcagaagttgaaagacggattgctggcgatagccgaaaaacacccggagatcggcgacgtacgcgggctgggggcgatgatcgccattgagctgtttgaagacggcgatcacaacaagccggacgccaaactcaccgccgagatcgtggctcgcgcccgcgataaaggcctgattcttctctcctgcggcccgtattacaacgtgctgcgcatccttgtaccgctcaccattgaagacgctcagatccgtcagggtctggagatcatcagccagtgttttgatgaggcgaagcagtag

SEQ ID NO: 356 - DNA, 1281 bp, Escherichia coli; identical to SEQ ID NO: 355

SEQ ID NO: 357 - DNA, 867 bp, Escherichia coli
atggccgaaaaaaaacagtggcatgaaacgctacacgaccagtttgggcagtactttgcggtagataacgttctgtatcatgaaaagaccgatcaccaggatctgatcatttttgagaacgctgcatttggtcgcgtaatggcgctggatggcgtagtacaaaccaccgagcgcgacgagtttatctatcatgagatgatgacccatgttccgctactggcccatggtcacgcgaaacatgtgctgattatcggcggcggcgacggtgccatgctgcgtgaagtaacccgacataaaaacgttgagtcaatcacgatggtggaaatcgatgcgggtgtcgtatcgttctgccgtcagtatctacccaaccataacgccggtagctacgacgatccgcgctttaagctggtgatcgacgatggcgtcaatttcgttaatcaaaccagccagacctttgatgtcattatctccgactgcaccgatcctatcggtcccggcgaaagccttttcacttcggcattttatgaaggctgcaaacgttgcctgaatcctggcggtatcttcgtcgcacaaaacggcgtctgctttttacagcaggaagaagccatcgacagccatcgcaaactcagccattacttcagcgacgttggcttttatcaggcggcgatcccgacctattacggcggtatcatgacttttgcatgggcgacagataacgacgccttacgccatctctcaaccgaaattattcaggcgcgttttctcgcctctggcctgaaatgccgttattacaatccggcaatccatacggcagcttttgccttacctcagtatctgcaagacgcactggcttcacagccgtcctaa

SEQ ID NO: 358 - DNA, 795 bp, Escherichia coli
ttgaaaaaactgaaactgcatggctttaataatctgaccaaaagtctgagtttttgtatttacgatatctgctacgccaaaactgccgaagagcgcgacggttatattgcttatatcgatgaactctataatgccaaccgtctgaccgaaatcctgtcagaaacctgttccattatcggggctaatattcttaacatcgcccgccaggattacgaaccacagggtgccagcgtcactattctggtgagtgaagaaccggttgacccgaaactcatcgacaaaacagaacaccccggcccactgccagaaacggtcgttgcccatcttgataaaagtcatatttgcgtacatacctacccggaaagtcatcctgaaggcggtttatgtaccttccgcgccgatattgaagtctctacctgcggcgtgatttctccgctgaaggcgctgaattacctgatccaccagcttgagtccgatatcgtaaccattgattatcgcgtgcgcggttttacccgcgacattaacggtatgaagcactttatcgaccatgagattaattcgattcagaactttatgtctgacgatatgaaggcgctgtatgacatggtggatgtgaacgtctatcaggaaaatatcttccataccaagatgttgcttaaagagttcgaccttaagcactacatgttccacaccaaaccggaagacttaaccgacagcgagcgccaggaaattaccgctgcgctgtggaaagaaatgcgcgagatttattacgggcgcaatatgccagctgtttaa

SEQ ID NO: 359 - DNA, 822 bp, Escherichia coli
atgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgctgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttgtaa

SEQ ID NO: 360 - DNA, 825 bp, Escherichia coli
atgcagcagttacagaacattattgaaaccgcttttgaacgccgtgccgagatcacgccagccaatgcagacaccgttacccgcgaagcggtaaatcaggtgatcgccctgctggattccggcgcactgcgtgtagcggaaaaaattgacggtcagtgggtgacgcatcagtggttgaaaaaagcggtgctgctctctttccgtattaatgataatcaggtgatcgaaggggcagaaagccgctacttcgacaaagtgccgatgaaattcgccgactacgacgaagcacgtttccagaaagaaggcttccgcgttgtgccaccagcggcggtacgtcagggtgcgtttattgcccgtaacaccgtgctgatgccgtcttacgtcaacatcggcgcatatgttgatgaaggcaccatggttgatacctgggcgaccgtcggttcttgtgcgcagattggtaaaaacgtccacctttccggtggcgtgggcatcggcggcgtgctggaaccgctgcaggctaacccaaccatcattgaagataattgcttcatcggcgcgcgctctgaagtggttgaaggggtgattgtcgaagaaggttccgtcatttccatgggcgtatacattggtcagagcacccgtatttacgaccgtgaaaccggcgaaatccactacggtcgcgttccggcggggtctgtggttgtttcaggtaatctgccgtcaaaagatggcaaatacagcctctactgtgcggttatcgttaagaaagttgacgcgaaaactcgcggcaaagtcggcattaacgaactgctgcgtaccatcgactaa

SEQ ID NO: 361 - DNA, 1128 bp, Escherichia coli
atgtcgtgcccggttattgagctgacacaacagcttattcgccgcccttccctgagtcctgatgatgcaggatgccaggctttgttgattgaacgtttgcaggcgatcggttttaccgttgaacgcatggactttgccgatacgcagaatttttgggcatggcgtgggcagggtgaaacgttagcctttgccgggcataccgacgtggtgccgcctggcgacgccgatcgttggatcaatcccccgtttgaacccaccattcgtgacggcatgttattcgggcgcggtgcggcagatatgaaaggctcgctggcggcgatggtggtggcggcagaacgttttgtcgcacaacatcccaaccatacggggcgactggcatttctgatcacctctgatgaagaagccagtgcccacaacggtacggtaaaagtcgtcgaagcgttaatggcacgtaatgagcgtctcgattactgcctggttggcgaaccgtcgagtatcgaagtggtaggtgatgtggtgaaaaatggtcgtcgcggatcattaacctgcaaccttaccattcatggcgttcaggggcatgttgcctacccacatctggctgacaatccggtacatcgcgcagcacctttccttaatgaattagtggctattgagtgggatcagggcaatgaattcttcccggcgaccagtatgcagattgccaatattcaggcgggaacgggcagtaacaacgttattccgggtgaactgtttgtgcagtttaacttccgcttcagcaccgaactgactgatgagatgatcaaagcgcaggtgcttgccctgcttgaaaaacatcaactgcgctatacggtggattggtggctttccgggcagccatttttgaccgcgcgcggtaaactggtggatgcggtcgttaacgcggttgagcactataatgaaattaaaccgcagctactgaccacaggcggaacgtccgacgggcgctttattgcccgcatgggggcgcaggtggtggaactcgggccggtcaatgccactattcataaaattaatgaatgtgtgaacgctgccgacctgcagctacttgcccgtatgtatcaacgtatcatggaacagctcgtcgcctga

SEQ ID NO: 362 - DNA, 825 bp, Escherichia coli
atgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatgctgatggcagtgaagtggcgcagtgcggcaacggtgcgcgctgctttgcccgttttgtgcgtctgaaaggactgaccaataagcgtgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccgcattgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcgtgtgcggcggttgcagtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatga

SEQ ID NO: 363 - DNA, 1263 bp, Escherichia coli
atgccacattcactgttcagcaccgataccgatctcaccgccgaaaatctgctgcgtttgcccgctgaatttggctgcccggtgtgggtctacgatgcgcaaattattcgtcggcagattgcagcgctgaaacagtttgatgtggtgcgctttgcacagaaagcctgttccaatattcatattttgcgcttaatgcgtgagcagggcgtgaaagtggattccgtctcgttaggcgaaatagagcgtgcgttggcggcgggttacaatccgcaaacgcaccccgatgatattgtttttacggcagatgttatcgatcaggcgacgcttgaacgcgtcagtgaattgcaaattccggtgaatgcgggttctgttgatatgctcgaccaactgggccaggtttcgccagggcatcgggtatggctgcgcgttaatccggggtttggtcacggacatagccaaaaaaccaataccggtggcgaaaacagcaagcacggtatctggtacaccgatctgcccgccgcactggacgtgatacaacgtcatcatctgcagctggtcggcattcacatgcacattggttctggcgttgattatgcccatctggaacaggtgtgtggtgctatggtgcgtcaggtcatcgaattcggtcaggatttacaggctatttctgcgggcggtgggctttctgttccttatcaacagggtgaagaggcggttgataccgaacattattatggtctgtggaatgccgcgcgtgagcaaatcgcccgccatttgggccaccctgtgaaactggaaattgaaccgggtcgcttcctggtagcgcagtctggcgtattaattactcaggtgcggagcgtcaaacaaatggggagccgccactttgtgctggttgatgccgggttcaacgatctgatgcgcccggcaatgtacggtagttaccaccatatcagtgccctggcagctgatggtcgttctctggaacacgcgccaacggtggaaaccgtcgtcgccggaccgttatgtgaatcgggcgatgtctttacccagcaggaagggggaaatgttgaaacccgcgccttgccggaagtgaaggcaggtgattatctggtactgcatgatacaggggcatatggcgcatcaatgtcatccaactacaatagccgtccgctgttaccagaagttctgtttgataatggtcaggcgcggttgattcgccgtcgccagaccatcgaagaattactggcgctggaattgctttaa

SEQ ID NO: 364 - DNA, 2148 bp, Escherichia coli
atgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgaagatattgctaataagatcaagcagaccactgacgaatatatcaacactattctgcctccgctgactaaagcactgtttaaatatgttcgtgaaggtaaatatactttctgtactcctggtcacatgggcggtactgcattccagaaaagcccggtaggtagcctgttctatgatttctttggtccgaataccatgaaatctgatatttccatttcagtatctgaactgggttctctgctggatcacagtggtccacacaaagaagcagaacagtatatcgctcgcgtctttaacgcagaccgcagctacatggtgaccaacggtacttccactgcgaacaaaattgttggtatgtactctgctccagcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggcggcgttctctcaggcttccatgatccacgttaaaggtgacgtaaacgaagaaacctttaacgaagcctacatgatgcacaccaccacttctccgcactacggtatcgtggcgtccactgaaaccgctgcggcgatgatgaaaggcaatgcaggtaagcgtctgatcaacggttctattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgactttaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagtgctgccgacgatggtaatgactccgtatgctgcattccagaaagagctgcacggtatgaccgaagaagtttacctcgacgaaatggtaggtcgtattaacgccaatatgatccttccgtacccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaataa

SEQ ID NO: 365 - DNA, 2142 bp, Escherichia coli
atgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataa

SEQ ID NO: 366 - DNA, 948 bp, Escherichia coli
gtgcctgatatgaagctttttgctggtaacgccaccccggaactagcacaacgtattgccaaccgcctgtacacttcactcggcgacgccgctgtaggtcgctttagcgatggcgaagtcagcgtacaaattaatgaaaatgtacgcggtggtgatattttcatcatccagtccacttgtgcccctactaacgacaacctgatggaattagtcgttatggttgatgccctgcgtcgtgcttccgcaggtcgtatcaccgctgttatcccctactttggctatgcgcgccaggaccgtcgcgtccgttccgctcgtgtaccaatcactgcgaaagtggttgcagacttcctctccagcgtcggtgttgaccgtgtgctgacagtggatctgcacgctgaacagattcagggtttcttcgacgttccggttgataacgtatttggtagcccgatcctgctggaagacatgctgcagctgaatctggataacccaattgtggtttctccggacatcggcggcgttgtgcgtgcccgcgctatcgctaagctgctgaacgataccgatatggcaatcatcgacaaacgtcgtccgcgtgcgaacgtttcacaggtgatgcatatcatcggtgacgttgcaggtcgtgactgcgtactggtcgatgatatgatcgacactggcggtacgctgtgtaaagctgctgaagctctgaaagaacgtggtgctaaacgtgtatttgcgtacgcgactcacccgatcttctctggcaacgcggcgaacaacctgcgtaactctgtaattgatgaagtcgttgtctgcgataccattccgctgagcgatgaaatcaaatcactgccgaacgtgcgtactctgaccctgtcaggtatgctggccgaagcgattcgtcgtatcagcaacgaagaatcgatctctgccatgttcgaacactaa

SEQ ID NO: 367 - DNA, 1596 bp, Escherichia coli; identical to SEQ ID NO: 267

SEQ ID NO: 368 - DNA, 1518 bp, Escherichia coli
atgtgcggtattgtcggtatcgccggtgttatgccggttaaccagtcgatttatgatgccttaacggtgcttcagcatcgcggtcaggatgccgccggcatcatcaccatagatgccaataactgcttccgtttgcgtaaagcgaacgggctggtgagcgatgtatttgaagctcgccatatgcagcgtttgcagggcaatatgggcattggtcatgtgcgttaccccacggctggcagctccagcgcctctgaagcgcagccgttttacgttaactccccgtatggcattacgcttgcccacaacggcaatctgaccaacgctcacgagttgcgtaaaaaactgtttgaagaaaaacgccgccacatcaacaccacttccgactcggaaattctgcttaatatcttcgccagcgagctggacaacttccgccactacccgctggaagccgacaatattttcgctgccattgctgccacaaaccgcttaatccgcggcgcgtatgcctgtgtggcgatgattatcggccacggtatggttgctttccgcgatccaaacgggattcgtccgctggtactgggaaaacgtgatattgacgagaaccgtacagaatatatggtcgcttccgaaagcgtagcgctcgatacgctgggctttgatttcctgcgtgacgtcgcgccgggcgaagcgatttacatcactgaagaagggcagttgtttacccgtcaatgtgctgacaatccggtcagcaatccgtgcctgtttgagtatgtatactttgcccgcccggactcgtttatcgacaaaatttccgtttacagcgcgcgtgtgaatatgggcacgaaactgggcgagaaaattgcccgcgaatgggaagatctggatatcgacgtggtgatcccgatcccagaaacctcgtgtgatatcgcgctggaaattgctcgtattctgggcaaaccgtaccgccagggcttcgttaaaaaccgctatgttggccgcacctttatcatgccgggccagcagctgcgtcgtaagtccgtgcgccgtaaactgaatgccaaccgcgccgagttccgcgataaaaacgtcctgctggtcgacgactccatcgtccgtggcaccacttctgagcagattatcgagatggcacgcgaagccggagcgaagaaagtgtacctcgcttctgcggcaccggaaattcgcttcccgaacgtttatggtattgatatgccgagcgccacggaactgatcgctcacggtcgcgaagttgatgaaattcgccagatcatcggtgctgacgggttgattttccaggatctgaacgatctgatcgacgccgttcgcgctgaaaatccggatatccagcagtttgaatgctcggtgttcaacggcgtctacgtcaccaaagatgttgatcagggctacctcgatttcctcgatacgttacgtaatgatgacgccaaagcagtgcaacgtcagaacgaagtggaaaatctcgaaatgcataacgaaggatga

SEQ ID NO: 369 - DNA, 1290 bp, Escherichia coli
atgaaagtattagtgattggtaacggcgggcgcgagcacgcgctggcctggaaagcggcccagtcgccgctggttgagactgtttttgttgctccgggtaatgcaggcactgcactggaacccgcgctgcaaaacgttgctattggcgtgaccgatatcccggcgctgttggatttcgcacaaaacgaaaagattgatctgaccatcgtcggcccggaagcgccgctggtgaaaggcgtggtcgataccttccgcgccgccgggctgaaaatcttcggcccaaccgcaggtgcggcccaactggaaggctcaaaagcgtttaccaaagatttcctggcccgccataagatccctacggcggaataccagaacttcaccgaggtagaacctgcgctggcgtatctgcgtgagaaaggcgcgccaatcgtcattaaagcggacggtctggctgccgggaaaggcgttatcgtggcgatgacgctggaagaagcggaagcggctgttcacgatatgctggcgggcaacgcttttggcgacgcgggtcatcgcatcgttatcgaagagttcctcgatggcgaagaagcgagctttatcgtgatggtggacggcgagcatgtgctgccgatggctaccagccaggatcacaaacgcgtaggcgataaagataccggaccaaacaccggcgggatgggcgcttactcccccgcgccggtagtaaccgatgacgttcatcagcgcaccatggaacgtattatctggccaaccgtgaaaggcatggcggcggaaggcaacacctacaccggttttctctacgcgggcctgatgatcgacaaacagggcaatccgaaggttattgaatttaactgccgctttggcgatccggaaacccagccgattatgctgcgcatgaagtccgatctggttgagctctgcctggcggcctgtgaaagcaaactggacgagaaaacgtccgagtgggatgaacgcgcttctctcggcgtggtgatggctgcgggtggatatccgggtgattaccgcaccggtgacgtgatccacggcctgccgctggaagaagtggcaggcggcaaagtgttccacgcgggcacaaaactggcggatgacgagcaggtagtgaccaacggcgggcgcgtactgtgcgtcaccgcgctgggtcataccgtggcagaagcgcagaaacgcgcctatgccttaatgaccgatatccactgggacgactgcttctgccggaaagatatcggctggcgcgctatcgaacgcgagcagaactaa

SEQ ID NO: 370 - DNA, 1179 bp, Escherichia coli
atgacgttattaggcactgcgctgcgtccggcagcaactcgcgtgatgttattaggctccggtgaactgggtaaagaagtggcaatcgagtgtcagcgtctcggcgtagaggtgattgccgtcgatcgctatgccgacgcaccagccatgcatgtcgcgcatcgctcccatgtcattaatatgcttgatggtgatgcattacgccgtgtggttgaactggaaaaaccacattatatcgtgccggagatcgaagctattgccaccgatatgctgatccaacttgaagaggaaggactgaatgttgtcccctgcgctcgcgcaacgaaattaacgatgaatcgcgagggtatccgtcgcctggcggcagaagagctgcagctgcccacttccacttatcgttttgccgatagcgaaagccttttccgcgaggcggttgctgacattggctatccctgcattgtaaaaccggtgatgagctcttccggcaaggggcagacgtttattcgttctgcagagcaacttgctcaggcatggaagtacgctcagcaaggcggtcgcgccggagcgggccgcgtaattgttgaaggcgtcgttaagtttgacttcgaaattaccctgctaaccgtcagcgcggtggatggcgtccatttctgtgcaccagtaggtcatcgccaggaagatggcgactaccgtgaatcctggcaaccacagcaaatgagcccgcttgcccttgaacgtgcgcaggagattgcccgtaaagtggtgctggcactgggcggttatgggttgtttggtgtcgagctatttgtctgtggtgatgaggtgattttcagtgaggtctcccctcgtccacatgataccgggatggtgacgttaatttctcaagatctctcagagtttgccctgcatgtacgtgccttcctcggacttccggttggcgggatccgtcagtatggtcctgcagcttctgccgttattctgccacaactgaccagtcagaatgtcacgtttgataatgtgcagaatgccgtaggcgcagatttgcagattcgtttatttggtaagccggaaattgatggcagccgtcgtctgggggtggcactggctactgcagagagtgttgttgacgccattgaacgcgcgaagcacgccgccggacaggtaaaagtacagggttaa

SEQ ID NO: 371 - DNA, 3888 bp, Escherichia coli
atgatggaaattctgcgtggttcgcctgcactgtcggcattccgaatcaacaaactgctggcacgttttcaggctgccaggctcccggttcacaatatttacgccgagtatgtccattttgctgacctcaatgcgccgttaaacgatgatgagcacgcacaacttgaacgcctgctgaaatatggcccggcactcgccagccacgccccgcaaggcaaactcctgctggtgaccccgcgtcctggcaccatctctccctggtcttcgaaagcgaccgatattgcccataactgcgggctacaacaggtaaaccgccttgagcgcggcgttgcttactatatagaagccggtacgctgaccaatgaacaatggcagcaggttaccgctgaactgcacgaccgcatgatggaaacggtcttttttgctttagatgatgcagagcagttgtttgcccaccatcaaccgactccggttaccagcgttgatttgctggggcagggccgtcaggcgctgatcgacgctaacctgcgtcttggcttggctctggcggaagatgaaattgactatctgcaggatgctttcacaaagcttggtcgtaacccgaacgacatcgaactgtatatgtttgcccaggcgaactccgagcactgccgccacaaaatttttaacgccgactgggttatcgatggtgaacagcagccgaaatcgctgttcaagatgatcaaaaatactttcgaaaccacgccagatcacgttctctctgcttataaagataacgccgccgtaatggaaggttctgaagtgggccgctactttgctgaccacgaaacgggccgctacgatttccatcaggaaccggcgcatattctgatgaaagtcgaaactcacaaccacccgacggcgatttctccgtggccgggcgcggcgaccggttccggcggtgaaatccgcgatgaaggtgccaccgggcgcggcgcaaagccgaaagcgggtctggttggtttctccgtttccaacctgcgaattcctggcttcgaacagccgtgggaagaagatttcggtaagcctgagcgcattgtcaccgcgctggacatcatgaccgaaggcccgctgggcggcgcggcgtttaacaacgaatttggtcgtccggcactgaacggctacttccgtacttatgaagaaaaagtgaacagccacaacggcgaagagctgcgcggttatcacaaaccgatcatgctggcgggcgggatcggcaacattcgcgccgatcacgtacaaaaaggcgagatcaacgtcggtgcgaagctggtcgttctcggcggcccggcaatgaacatcggtcttggcggtggtgcagcgtcttctatggcgtctggtcagtctgatgccgacctcgactttgcttccgtacagcgcgacaacccggagatggagcgtcgctgccaggaagtgatcgaccgttgctggcagcttggtgatgccaacccaatcctgtttatccacgacgttggcgctggcggtctttctaacgccatgccggaactggtgagcgacggcgggcgcggcggtaaatttgaactgcgcgagattctaagcgacgaaccgggcatgagcccgctggaaatctggtgtaacgaatcccaggaacgctacgtgctggcggttgctgccgatcaattaccgctgtttgacgaactgtgtaagcgtgagcgcgcaccctacgcggtgattggtgaagcgaccgaagaactgcatctttctctgcacgatcgtcattttgataatcagccgatcgatctgccgctggacgtcctgcttggtaaaacgccgaagatgacccgcgatgtacaaacgctgaaagcgaaaggcgacgcgctggcccgtgaagggatcaccattgcagacgcggtgaaacgtgtgctgcatctgccgactgtggcggaaaaaaccttcctggtgaccattggcgaccgcagcgtaaccggcatggtagcgcgcgatcagatggtggggccgtggcaggtgccggtcgctaactgcgcggtcactaccgccagcctcgacagctactacggtgaagcgatggcgattggcgagcgtgcgccggttgcgctgctggatttcgccgcctctgcccgtctggcggtcggtgaagcgttaaccaacatcgccgcaacacaaattggcgatatcaaacgcatcaaactttccgccaactggatggcggcggcaggccaccctggtgaagatgcgggcctgtatgaagccgttaaagccgtgggcgaagagctttgtccggcgctgggcctgacgatcccggtgggtaaagactccatgtcgatgaaaacccgctggcaggaaggtaacgaagagcgcgaaatgacgtcgccgctgtcgctggtgatttctgcatttgcccgcgtggaagatgtacgtcacaccatcacgccgcagctttctaccgaagataacgcactgctgctgattgatttgggcaaaggcaataacgcgctgggcgcaacggcgctggcgcaggtttatcgtcagcttggcgacaaaccggcagatgtacgcgatgtcgcgcaactgaaaggcttctatgacgcgattcaggcgctggttgcacagcgtaagctgctggcgtatcacgaccgctctgatggcggcctgctggtaacgctggcggaaatggcctttgctggtcattgtggcattgacgcggatatcgccactctgggtgacgatcgcctggcggcgttgtttaacgaagaactgggtgcggtgattcaggttcgtgccgctgaccgtgaagcggtcgagtccgtactggcacagcatgggcttgctgattgtgtccattatgtagggcaggcggtttccggtgaccgttttgtgattaccgccaacgggcagactgtattcagcgaaagccgcaccacgttgcgtgtctggtgggcagaaactacctggcagatgcagcgcctgcgtgacaacccggagtgtgccgatcaggagcatcaggcgaaatctaacgacgccgatccgggcctgaatgtaaaactgtcgttcgatatcaacgaagatgtggcagcaccgtatattgccactggcgcacgtccgaaagttgccgtactgcgtgagcagggcgtgaactcgcatgttgaaatggcggcagctttccaccgtgcaggctttgatgctatcgacgtgcatatgagtgacctgctgaccggacgcacgggcctggaagatttccacgccctggtcgcgtgcggtggtttctcctacggtgatgtgctgggtgccggtgaaggttgggcgaagtcaatcctgttcaatgaccgtgtacgcgatgagtttgcaaccttcttccaccgtccgcaaacgctggcgctgggggtatgtaacggttgccagatgatgtctaatctgcgtgaactgatcccaggtagtgagttgtggccacgttttgtgcgcaatacctccgatcgctttgaagcgcgtttcagcctggttgaagtaacccaaagcccgtctctgctgttgcaggggatggtgggctcgcaaatgccgattgctgtctctcatggtgaagggcgcgtggaagtgcgtgatgcggcgcatctggcggcactggaaagcaaagggctggtggcactgcgctatgtcgataacttcggcaaagtcactgaaacctacccggctaacccgaacggttcaccgaacggtattacggcagtcacgactgaaagtggtcgagtcaccattatgatgccgcacccggaacgtgttttccgtactgtcagcaactcctggcatccggaaaactggggcgaggatggcccatggatgcgcattttccgcaatgcgcgtaagcagttggggtaa

SEQ ID NO: 372 - DNA, 1038 bp, Escherichia coli
gtgaccgataaaacctctcttagctacaaagatgccggtgttgatattgacgcgggtaatgctctggttggaagaatcaaaggcgtagtgaagaaaacgcgtcgtccggaagtgatgggcggtctgggcggcttcggtgcgctgtgtgcattgccgcaaaaatatcgtgaacccgtgctggtttctggcactgacggcgtaggtaccaagctgcgtctggcaatggacttaaaacgtcacgacaccattggtattgatctggtcgccatgtgcgttaatgacctggtggtgcaaggtgcagagccgctgtttttcctcgactattacgcaaccggaaaactggatgttgataccgcttcagcggtgatcagcggcattgcggaaggttgtctgcaatcaggctgttcactggtgggtggcgaaacggcagaaatgccggggatgtatcacggtgaggattacgatgtcgcgggtttctgcgttggcgtggtagaaaaatcagaaatcatcgacggctctaaagtcagcgacggcgatgtgctgattgcactcggttccagcggtccacactcgaacggctattcgctggtgcgcaaaattcttgaagtcagcggttgtgatccgcaaaccaccgaacttgatggtaagccattagccgatcatctgctggcaccgacccgcatttacgtgaagtcagtgctggagttgattgaaaaggtcgatgtgcatgccattgcgcacctgaccggcggcggcttctgggaaaacattccgcgcgtattgccagataatactcaggcagtgattgatgaatcttcctggcagtggccggaagtgttcaactggctgcaaacggcaggtaacgttgagcaccatgaaatgtatcgcaccttcaactgcggcgtcgggatgattattgccctgcctgctccggaagtggacaaagccctcgccctgctcaatgccaacggtgaaaacgcgtggaaaatcggtatcatcaaagcctctgattccgaacaacgcgtggttatcgaataa

SEQ ID NO: 373 - DNA, 1068 bp, Escherichia coli
atgaaacaggtttgcgtcctcggtaacgggcagttaggccgtatgctgcgtcaggcaggcgaaccgttaggcattgctgtctggccagtcgggctggacgctgaaccggcggcggtgccttttcaacaaagcgtgattaccgctgagatagaacgctggccggaaaccgcattaacccgcgagctggcgcgccatccggcctttgtgaaccgcgatgtgttcccgattattgctgaccgtctgactcagaagcagcttttcgataagctccacctgccgactgcaccgtggcagttacttgccgaacgcagcgagtggcctgcggtgtttgatcgtttaggtgagctggcgattgttaagcgtcgcactggtggttatgacggtcgcggtcaatggcgtttacgcgcaaatgaaaccgaacagttaccggcagagtgttacggcgaatgtattgtcgagcagggcattaacttctctggtgaagtgtcgctggttggcgcgcgcggctttgatggcagcaccgtgttttatccgctgacgcataacctgcatcaggacggtattttgcgcaccagcgtcgcttttccgcaggccaacgcacagcagcaggcgcaagccgaagagatgctgtcggcgattatgcaggagctgggctatgtgggcgtgatggcgatggagtgttttgtcaccccgcaaggtctgttgatcaacgaactggcaccgcgtgtgcataacagcggtcactggacacaaaacggtgccagcatcagccagtttgagctgcatctgcgggcgattaccgatctgccgttaccgcaaccagtggtgaataatccgtcggtgatgatcaatctgattggtagcgatgtgaattatgactggctgaaactgccgctggtgcatctgcactggtacgacaaagaagtccgtccggggcgtaaagtggggcatctgaatttgaccgacagcgacacatcgcgtctgactgcgacgctggaagccttaatcccgctgctgccgccggaatatgccagcggcgtgatttgggcgcagagtaagttcggttaa

SEQ ID NO: 374 - DNA, 510 bp, Escherichia coli
atgtcttcccgcaataatccggcgcgtgtcgccatcgtgatggggtccaaaagcgactgggctaccatgcagttcgccgccgaaatcttcgaaatcctgaatgtcccgcaccacgttgaagtggtttctgctcaccgcacccccgataaactgttcagcttcgccgaaagcgccgaagagaacggttatcaggtgattattgcgggcgcaggcggcgcagcgcatctgccaggcatgattgccgccaaaacgctggtgccggtgctgggcgtgccagtacagagcgccgcactgagcggtgtcgatagcctctactccatcgtacaaatgccgcgcggcattccggtgggtacgctggcgattggtaaagctggcgcggcaaacgcggcgttactggcagcacaaattcttgcgactcatgataaagaactgcaccagcgtctgaatgactggcgcaaagcccagaccgacgaagtgctggaaaacccggacccgcgaggtgcggcatga

SEQ ID NO: 375 - DNA, 714 bp, Escherichia coli
atgcaaaagcaagctgagttgtatcgtggtaaagcgaaaaccgtatacagcacggaaaacccggacctgttggtgctcgaattccgcaatgatacgtcagcaggggatggcgcgcgcattgagcagtttgatcgcaaaggtatggtgaacaacaagttcaactacttcattatgagcaaactggctgaagcgggtatcccgactcaaatggagcgtctgctctccgataccgaatgtctggtgaaaaagctggatatggtgccggttgagtgtgtcgtgcgtaaccgtgctgctggctctctggtgaaacgtcttggaatcgaagaaggtattgagctgaacccgccgctgttcgatctgttcctgaaaaacgacgccatgcacgatccgatggtcaacgaatcttactgcgaaacctttggctgggtgagcaaagagaacctggcgcgtatgaaagagctgacctacaaagcgaacgacgtgctgaaaaaactgttcgatgatgctggtctgattctggtcgacttcaagctggaatttggtctgtacaaaggcgaagtggtactgggtgatgagttctccccggacggtagccgcctgtgggacaaagaaacgctggagaaaatggacaaagaccgtttccgccagagcctcggtggcctgatcgaagcctatgaagccgtcgcccgccgcctgggtgtacagctggactga

SEQ ID NO: 376 - DNA, 1371 bp, Escherichia coli
atggaattatcctcactgaccgccgtttcccctgtcgatggacgctacggcgataaagtcagcgcgctgcgcgggattttcagcgaatatggtttgctgaaattccgtgtacaagttgaagtacgttggctgcaaaaactggccgcgcacgcagcgatcaaggaagttcctgcttttgctgccgacgcaatcggttaccttgatgcaatcgtcgccagtttcagcgaagaagatgcggcgcgcatcaaaactatcgagcgtaccactaaccacgacgttaaagcggttgagtatttcctgaaagaaaaagtggcggagatcccggaactgcacgcggtttctgaattcatccactttgcctgtacttcggaagatatcaataacctctcccacgcattaatgctgaaaaccgcgcgtgatgaagtgatcctgccatactggcgtcaactgattgatggcattaaagatctcgccgttcagtatcgcgatatcccgctgctgtctcgtacccacggtcagccagccacgccgtcaaccatcggtaaagagatggcaaacgtcgcctaccgtatggagcgccagtaccgccagcttaaccaggtggagatcctcggcaaaatcaacggcgcggtcggtaactataacgcccacatcgccgcttacccggaagttgactggcatcagttcagcgaagagttcgtcacctcgctgggtattcagtggaacccgtacaccacccagatcgaaccgcacgactacattgccgaactgtttgattgcgttgcgcgcttcaacactattctgatcgactttgaccgtgacgtctggggttatatcgcccttaaccacttcaaacagaaaaccattgctggtgagattggttcttccaccatgccgcataaagttaacccgatcgacttcgaaaactccgaagggaatctgggcctttccaacgcggtattgcagcatctggcaagcaaactgccggtttcccgctggcagcgtgacctgaccgactctaccgtgctgcgtaacctcggcgtgggtatcggttatgccttgattgcatatcaatccaccctgaaaggcgtgagcaaactggaagtgaaccgtgaccatctgctggatgaactggatcacaactgggaagtgctggctgaaccaatccagacagttatgcgtcgctatggcatcgaaaaaccgtacgagaagctgaaagagctgactcgcggtaagcgcgttgacgccgaaggcatgaagcagtttatcgatggtctggcgttgccagaagaagagaaagcccgcctgaaagcgatgacgccggctaactatattggtcgagctatcacgatggttgatgagctgaaataa

SEQ ID NO: 377 - DNA, 1590 bp, Escherichia coli
atgcaacaacgtcgtccagtccgccgcgctctgctcagtgtttctgacaaagccggtatcgtcgaattcgcccaggcactttccgcacgcggtgtggagctgctgtctacagggggcactgcccgtctgttagcagaaaaaggtctgccggtaaccgaagtttccgattacaccggtttcccggagatgatggatggacgcgtgaagaccctgcatccgaaagtacatggtggcattctgggccgtcgcggccaggacgatgccattatggaagaacatcagatccagcctatcgatatggtggttgttaacctgtatccgttcgcccagaccgtggcccgtgaaggttgctcgctggaagatgcggttgagaacatcgatatcggcggcccaacgatggtgcgctccgccgccaagaaccataaagatgtcgcaatcgtggtgaagagcagcgactatgacgccattattaaagagatggatgacaacgaaggatcgctgacgcttgcaacccgtttcgacctcgccatcaaagccttcgaacacactgccgcctacgacagcatgattgccaactacttcggcagcatggttccggcttaccacggtgaaagcaaagaagccgccggtcgcttcccacgcacgctgaacctgaacttcattaagaagctggatatgcgttacggcgagaacagccaccagcaggctgccttctatatagaagagaatgtgaaagaagcctccgttgctaccgcaacccaggttcagggtaaagccctctcttataacaacatcgccgataccgatgcggcgctggagtgcgtgaaagagttcgccgagccggcatgtgtgattgtgaagcacgccaacccttgcggcgtggctatcggcaattccattcttgatgcttacgatcgcgcgtacaaaaccgacccaacctccgcattcggcggcatcattgcctttaaccgcgagctggatgcggaaaccgcacaggccatcatttctcgtcagtttgtcgaagtgattattgcgccgtccgccagcgaagaagccctgaaaatcaccgccgccaaacagaacgtacgcgttctgacctgcggtcagtggggcgagcgtgttccgggcctcgatttcaaacgcgtgaacggcggtctgctggttcaggatcgtgacctggggatggtcggtgcggaagaactgcgcgtggtgaccaaacgtcagccgagcgaacaggaactgcgtgatgcgctgttctgctggaaggtggcgaagtttgtgaaatccaacgctatcgtctatgccaaaaacaatatgactatcggcattggcgcgggccagatgagccgcgtgtactccgcaaaaatcgccggtattaaagcggccgatgaaggcctggaagtgaaaggttcctcgatggcttctgacgcgttcttcccgttccgcgacggtattgatgccgccgccgctgcgggcgtgacctgcgtaatccagcctggcggttctatccgtgatgacgaagtgattgccgccgccgacgagcacggtattgcgatgctcttcaccgacatgcgccacttccgccattaa

SEQ ID NO: 378 - DNA, 1467 bp, Escherichia coli
atgctacgtatcgctaaagaagctctgacgtttgacgacgttctcctcgttcctgctcactctaccgttctgccgaatactgctgacctcagcacccagctgacgaaaactattcgtctgaatatccctatgctttccgcagcaatggataccgtaacggaagcgcgcctggctattgctctggctcaggaaggcggtatcggctttatccacaaaaacatgtccattgaacgccaggcagaagaagttcgccgtgtgaaaaaacacgaatctggtgtggtgactgatccgcagactgttctgccaaccacgacgctgcgcgaagtgaaagaactgaccgagcgtaacggttttgcgggctatccggtcgttaccgaagaaaacgaactggtgggtattatcaccggtcgtgacgtgcgttttgttaccgacctgaaccagccggttagcgtttacatgacgccgaaagagcgtctggtcaccgtgcgtgaaggtgaagcccgtgaagtggtgctggcaaaaatgcacgaaaaacgcgttgaaaaagcgctggtggttgatgacgaattccacctgatcggcatgatcaccgtgaaagacttccagaaagcggaacgtaaaccgaacgcctgtaaagacgagcaaggccgtctgcgtgttggtgcagcggttggcgcaggtgcgggtaacgaagagcgtgttgacgcgctggttgccgcaggcgttgacgttctgctgatcgactcctcccacggtcactcagaaggtgtactgcaacgtatccgtgaaacccgtgctaaatatccggatctgcaaattatcggcggcaacgtggcaacagctgcaggtgcacgcgctctggcagaagctggttgcagtgcggttaaagtcggcattggccctggctctatctgtacaactcgtatcgtgactggcgtcggtgttccgcagattaccgctgttgctgacgcagtagaagccctggaaggcaccggtattccggttatcgctgatggcggtattcgcttctccggcgacatcgccaaagctatcgccgctggcgcaagcgcggtgatggtaggttccatgctggcgggtactgaagaatctccgggtgaaatcgaactctaccagggccgttcttacaaatcttaccgtggtatgggttccctgggcgcgatgtccaaaggttcctctgaccgttatttccagagcgataacgctgccgacaaactggtgccggaaggtatcgaaggtcgcgtagcctataaaggtcgcctgaaagagatcattcaccagcagatgggcggcctgcgctcctgtatgggtctgaccggctgtggtactatcgacgaactgcgtactaaagcggagtttgtacgtatcagcggtgcgggcattcaggaaagccacgttcacgacgtgaccattactaaagagtccccgaactaccgtctgggctcctga

SEQ ID NO: 379 - DNA, 1578 bp, Escherichia coli
atgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaatccaagcggcattattctttccggcggcccggaaagtactactgaagaaaacagtccgcgtgcgccgcagtatgtctttgaagcaggcgtaccggtattcggcgtttgctatggcatgcagaccatggcaatgcagttgggcggtcacgttgaagcctctaacgaacgtgaatttggctacgcgcaggttgaagtcgtaaacgacagcgcactggttcgcggtatcgaagatgcgctgaccgcagacggtaaaccgctgctcgatgtctggatgagccacggcgataaagttaccgctattccgtccgacttcatcaccgtagccagcaccgaaagctgcccgtttgccattatggctaacgaagaaaaacgcttctatggcgtacagttccacccggaagtgactcatacccgccagggtatgcgcatgctggagcgttttgtgcgtgatatctgccagtgtgaagccctgtggacgccagcgaaaattatcgacgatgctgtagctcgcatccgcgagcaggtaggcgacgataaagtcatcctcggcctctctggtggtgtggattcctccgtaaccgcaatgctgctgcaccgcgctatcggtaaaaacctgacttgcgtattcgtcgacaacggcctgctgcgcctcaacgaagcagagcaggttctggatatgtttggcgatcactttggtcttaacattgttcacgtaccggcagaagatcgcttcctgtcagcgctggctggcgaaaacgatccggaagcaaaacgtaaaatcatcggtcgcgttttcgttgaagtattcgatgaagaagcgctgaaactggaagacgtgaagtggctggcgcagggcaccatctaccctgacgttatcgaatctgcggcgtctgcaaccggtaaagcacacgtcatcaaatctcaccacaacgtgggcggcctgccgaaagagatgaagatgggcctggttgaaccgctgaaagagctgttcaaagacgaagtgcgtaagattggtctggagctgggcctgccgtacgacatgctgtaccgtcacccgttcccgggaccaggccttggcgttcgtgttctgggtgaagtgaagaaagagtactgtgacctgctgcgccgtgctgacgccatcttcattgaagaactgcgtaaagcggacctgtacgacaaagtcagccaggcgttcactgtgttcctgccggtacgttccgttggcgtaatgggcgatggtcgtaagtatgactgggttgtctctctgcgtgctgtcgaaaccatcgactttatgaccgcacactgggcgcatctgccgtacgatttcctcggtcgcgtttccaaccgcattatcaatgaagtgaacggtatttcccgcgtggtgtatgacatcagcggcaagccgccagctaccattgagtgggaatga

SEQ ID NO: 380 - DNA, 624 bp, Escherichia coli
atggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagcagagatgcgttcctcgaacacgcagaagtttttggtaattactatggcacttcgcgtgaggccattgagcaagtactggcgaccggtgtcgatgtttttctcgatatcgactggcagggcgcgcagcaaattcgccagaagatgccgcacgcgcggagtatctttattttaccgccgtccaaaattgaactggaccgccgtctacgcggtcgcggtcaggacagcgaagaggtcattgcaaagcgtatggcgcaagctgttgcagaaatgagccattacgccgaatatgattatctgattgtgaatgatgacttcgataccgcgttgaccgatttgaagaccattattcgcgccgaacgtctgcgcatgagccgccaaaagcagcgtcatgacgctttaatcagcaaattgttggcagactga

SEQ ID NO: 381 - DNA, 432 bp, Escherichia coli
atggctattgaacgtactttttccatcatcaaaccgaacgcggtagcaaaaaacgtcattggtaatatctttgcgcgctttgaagctgcagggttcaaaattgttggcaccaaaatgctgcacctgaccgttgaacaggcacgtggcttttatgctgaacacgatggaaaaccgttctttgatggtctggttgaattcatgacctctggcccgatcgtggtttccgtgctggaaggtgaaaacgccgttcagcgtcaccgcgatctgctgggcgcgaccaatccggcaaacgcactggctggtactctgcgcgctgattacgctgacagcctgaccgaaaacggtacccacggttctgattccgtcgaatctgccgctcgcgaaatcgcttatttctttggcgaaggcgaagtgtgcccgcgcacccgttaa

SEQ ID NO: 382 - DNA, 2286 bp, Escherichia coli
atgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctga

SEQ ID NO: 383 - DNA, 1131 bp, Escherichia coli
atggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctga

SEQ ID NO: 384 - DNA, 2139 bp, Escherichia coli
atgacaccgcatgtgatgaaacgagacggctgcaaagtgccgtttaaatcagagcgcatcaaagaagcgattctgcgtgcagctaaagcagcggaagtcgatgatgccgattattgcgccactgttgccgcggttgtcagcgagcagatgcagggccgcaaccaggtggatatcaatgagatccagaccgcagttgaaaatcagctgatgtcaggtccatacaaacaactggctcgtgcttacatcgagtaccgtcacgatcgcgacattgaacgtgaaaaacgcggtcgcctgaaccaggagatccgtggtctggtcgagcagaccaacgcctcgttactcaacgaaaacgccaacaaagacagcaaggtgattccaacccagcgcgacctgctggccgggatcgtggctaaacactatgcacgtcagcacctgctgccgcgtgacgtggtgcaggcacatgagcgtggcgatattcactatcacgatctcgattactcaccgttcttcccgatgttcaactgcatgttgatcgacctgaaaggcatgctgacccagggctttaaaatggggaacgccgagattgaaccgccgaagtcgatctctacggcaaccgcggtaactgcgcagattattgctcaggttgccagccatatttatggcggcaccaccattaaccgtatcgatgaagtgctggcaccgtttgtcactgccagctacaacaaacatcgcaagaccgcagaagagtggaacatcccggacgccgaaggctacgctaactctcgaaccatcaaagagtgctacgatgccttccagtcactggagtacgaagtaaacaccctgcacaccgccaacggtcagacgccgtttgtaacctttggttttggcctgggcaccagctgggaatcgcgcctgattcaggaatcgatcctgcgtaaccgtatcgcaggcctcggtaaaaaccgtaaaactgcggtgttcccgaaactggtgtttgcgattcgcgatggcctgaaccataaaaaaggcgatccgaactacgacatcaaacagctggcgctggagtgcgcaagcaagcgcatgtatccggatatcctgaactacgatcaggtagtgaaagtcaccggttcgtttaaaactccgatgggctgccgcagcttcctcggcgtgtgggaaaatgaaaacggcgagcagatccacgatggtcgtaacaacctcggcgtgatcagcctgaacctgccgcgtattgctctggaagcaaaaggcgatgaagccaccttctggaagctgctggatgaacgtctggtgctggcacgtaaggcgctgatgacccgtatcgctcgtctcgaaggcgtgaaagcgcgcgtggccccgatcctctatatggaaggtgcttgtggcgtgcgtctcaatgctgacgatgatgtttctgaaatcttcaaaaacggtcgtgcgtctatttcgctgggttacatcggcatccacgaaaccattaacgcgctgttcggcggcgagcatgtttacgacaacgagcagcttcgcgcgaaaggtatcgccattgttgaacgtctgcgtcaggcagtggatcagtggaaagaagaaacgggttatggtttcagtctctacagcacgccgagtgaaaacctgtgcgatcgcttctgccgtctcgatactgctgagtttggcgtggtgccgggcgtgaccgataaaggttactacaccaacagtttccacctcgatgtggagaagaaggtgaacccgtacgacaagatcgactttgaagcgccttacccgccgctggcgaacggtggtttcatttgctacggcgagtatccaaacattcagcacaacctgaaggcgctggaagatgtctgggattacagctatcagcatgtaccgtattacggcaccaatacaccgattgatgagtgctacgagtgtggctttaccggtgagttcgagtgcaccagcaaaggcttcacttgcccgaaatgtggtaaccatgacgcctcccgtgtgtcggtaactcgccgcgtgtgcggatatttaggtagcccggatgcacgtccgtttaacgctggtaagcaggaagaagttaagcgccgcgttaaacatttggggaatgggcagataggttaa

SEQ ID NO: 385 - DNA, 645 bp, Escherichia coli
atgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgaccgtatcgtcggtcgccgcgttcatgcgccgtctggtcgtgtttatcacgttaaattcaatccgccgaaagtagaaggcaaagacgacgttaccggtgaagaactgactacccgtaaagatgatcaggaagagaccgtacgtaaacgtctggttgaataccatcagatgacagcaccgctgatcggctactactccaaagaagcagaagcgggtaataccaaatacgcgaaagttgacggcaccaagccggttgctgaagttcgcgctgatctggaaaaaatcctcggctaa

SEQ ID NO: 386 - DNA, 960 bp, Escherichia coli
atgaaactctcacgtatcagcgccatcaactggaacaagatatctgacgataaagatctggaggtgtggaatcgcctgaccagcaatttctggctaccagaaaaggtgccgctgtcgaacgatattcctgcctggcagacattaactgtcgtagaacaacaactgacgatgcgcgtttttactggcctgacgctgctcgacacgctgcaaaatgttatcggcgcgccttctctgatgcccgatgcactcacgcctcatgaagaagcggtattatcgaatatcagctttatggaagcggttcatgcccgctcttacagttcgattttctcgacgctatgccagaccaaagatgtcgatgccgcctacgcctggagtgaagaaaacgcaccgttgcagcgaaaagctcagattattcagcaacattatcgcggtgatgatccgctgaaaaagaaaatcgccagtgtgtttcttgaatcttttttgttctattccggtttctggctgccgatgtatttttccagccgcggaaagctgaccaataccgcggacctgatccgtctgattatccgcgatgaagcagtccacggttactacataggctataaatatcagaaaaacatggaaaagatatctctgggacaacgtgaagagttgaagagtttcgccttcgatttgttgctggaactctacgacaacgagttgcaatacaccgatgagctgtacgccgaaaccccgtgggctgacgatgtgaaagcgtttctctgttacaacgccaataaggctttgatgaatctgggctacgaaccgttatttcccgcagaaatggcggaagtgaatccggcaatcctcgccgcgctttcgccgaatgccgatgaaaatcacgatttcttttccggttcaggctcctcttatgtgatggggaaagcggttgaaacagaagatgaagactggaatttctga

SEQ ID NO: 387 - DNA, 2145 bp, Escherichia coli
ttggcaacgacaaccgcagaatgcctgacgcaggaaacgatggattaccacgcgctgaatgcgatgcttaacctctacgatagcgcaggtcgcattcagttcgataaagaccgccaggccgttgacgcctttattgcgacgcatgtgcgtccgaacagtgtgaccttcagtagccagcagcagcgcctgaactggctggtcaacgaaggttactatgatgaaagcgttcttaatcgctactctcgcgactttgtcattacgctgtttacccacgcacacaccagcggttttcgtttccagacattcctcggggcatggaagttttacaccagctatacgttgaagacattcgacggtaaacgttatctggaagattttgccgatcgagtaacgatggtggcgctgacgctggcacaaggcgatgagacgctggcgttgcaactgaccgatgaaatgctgtcaggacgctttcagccagccacgccaacattcctcaactgcggtaagcagcagcgcggcgaactggtttcctgttttttgctgcgtattgaagacaatatggagtcgattggtcgggcggtaaattccgcactgcagctgtcgaaacgcggcggcggcgtagcatttttgctgtcgaatctgcgagaagcgggcgcgccaattaaacgtattgaaaatcaatcttctggcgtaattccggtgatgaaaatgctggaagacgcattttcctatgccaaccaactcggcgctcgtcagggggctggtgcagtctatttacatgctcatcatcccgatattctgcgttttctcgacacgaaacgggaaaatgccgacgaaaaaatccgcattaaaacactgtcgcttggcgtggtgatcccggatatcactttccatctggcaaaagagaatgcgcagatggcgctgttttcgccttatgacgtagagcgagtttatggcaagccgtttgccgatgtggccatcagccaacactatgacgaactggttgccgatgaacgcattcgcaaaaaatacctcaacgcccgtgatttcttccagcgactggcagaaatccagtttgagtccggctatccctacatcatgtatgaagacacggtaaaccgtgctaaccctatcgccgggcgcataaatatgagtaatctctgctcagaaattttgcaggttaacagcgcctcagagtatgacgagaatctcgactatacccgcacaggccatgatatttcctgcaatttaggttcgttgaatattgcgcacaccatggattcccccgattttgcccgcacggtagagactgccgtgcgcggtttaacggcagtatcagatatgagtcatatccgcagcgtgccgtccatcgaagccggaaatgccgcctcgcacgccatcggactggggcagatgaatttacacggctatctggcgcgagaaggcatcgcttatggttcgccggaagcactggatttcaccaatctctatttctatgccatcacctggcatgcactgcgtacctcgatgttgctggcacgcgaacgcggtgaaaccttcgccgggttcaaacagtcacgctatgccagtggtgaatattttagccaatatctgcaagggaactggcagccgaaaacggcgaaagttggcgaactgtttacccgtagcggtattacgttacctacccgtgagatgtgggcgcagctgcgcgacgacgtgatgcgctacggcatatacaaccagaatcttcaggcggtgccgccaaccggttctatctcttatatcaaccatgctacgtcgagtattcatccgattgtggcgaaagtagagatacgcaaagagggcaaaacaggacgcgtttactaccctgccccgtttatgactaacgagaatctggcgctgtatcaggacgcttacgaaattggcgcagaaaagatcatcgacacctacgcggaagcgactcgccatgtcgatcaggggctgtcgctgacgctttttttccccgataccgccaccactcgcgatatcaacaaagcgcagatttacgcctggcgcaagggtatcaaaacgctctattacatccgcctgcgtcagatggcgctggaaggcactgaaattgaaggctgcgtctcctgtgcactttaa

SEQ ID NO: 388 - DNA, 1299 bp, Escherichia coli
atgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggccgcgctgatgaaagagatgaaagaactggaagaccgtggcatccccgttcgtgagcgtctgctgctgtctgaagcatgtccgctgatccttgattatcacgttgcgctggataacgcgcgtgagaaagcgcgtggcgcgaaagcgatcggcaccaccggtcgtggtatcgggcctgcttatgaagataaagtagcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtaggtgcaggtccgttcccgaccgaactgtttgatgaaactggcgagttcctctgcaagcagggtaacgaattcggcgcaactacggggcgtcgtcgtcgtaccggctggctggacaccgttgccgttcgtcgtgcggtacagctgaactccctgtctggcttctgcctgactaaactggacgttctggatggcctgaaagaggttaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactatatcaagcgtattgaagagctgactggtgtgccgatcgatatcatctctaccggtccggatcgtactgaaaccatgattctgcgcgacccgttcgacgcgtaa

SEQ ID NO: 389 - DNA, 462 bp, Escherichia coli
atgacacacgataataaattgcaggttgaagctattaaacgcggcacggtaattgaccatatccccgcccagatcggttttaagctgttgagtctgttcaagctgaccgaaacggatcagcgcatcaccattggtctgaacctgccttctggcgagatgggccgcaaagatctgatcaaaatcgaaaatacctttttgagtgaagatcaagtagatcaactggcattgtatgcgccgcaagccacggttaaccgtatcgacaactatgaagtggtgggtaaatcgcgcccaagtctgccggagcgcatcgacaatgtgctggtctgcccgaacagcaactgtatcagccatgccgaaccggtttcatccagctttgccgtgcgaaaacgcgccaatgatatcgcgctcaaatgcaaatactgtgaaaaagagttttcccataatgtggtgctggccaattaa

SEQ ID NO: 390 - DNA, 936 bp, Escherichia coli; identical to SEQ ID NO: 297

SEQ ID NO: 391 - DNA, 1047 bp, Escherichia coli
atgactgcaccatcccaggtattaaagatccgccgcccagacgactggcaccttcacctccgcgatggcgacatgttaaaaactgtcgtgccatataccagcgaaatttatggacgggctatcgtaatgcccaatctggctccgcccgtgaccaccgttgaggctgccgtggcgtatcgccagcgtattcttgacgccgtacctgccgggcacgatttcaccccattgatgacctgttatttaacagattcgctggatcctaatgagctggagcgcggatttaacgaaggcgtgttcaccgctgcaaaactttacccggcaaacgcaaccactaactccagccacggcgtgacgtcaattgacgcaatcatgccggtacttgagcgcatggaaaaaatcggtatgccgctactggtgcatggtgaagtgacacatgcagatatcgacatttttgatcgtgaagcgcgctttatagaaagcgtgatggaacctctgcgccagcgcctgactgcgctgaaagtcgtttttgagcacatcaccaccaaagatgctgccgactatgtccgtgacggaaatgaacggctggctgccaccatcactccgcagcatctgatgtttaaccgcaaccatatgctggttggaggcgtgcgtccgcacctgtattgtctacccatcctcaaacgtaatattcaccaacaggcattgcgtgaactggtcgccagcggttttaatcgagtattcctcggtacggattctgcgccacatgcacgtcatcgcaaagagagcagttgcggctgcgcgggctgcttcaacgccccaaccgcgctgggcagttacgctaccgtctttgaagaaatgaatgctttgcagcactttgaagcattctgttctgtaaacggcccgcagttctatgggttgccggtcaacgacacattcatcgaactggtacgtgaagagcaacaggttgctgaaagcatcgcactgactgatgacacgctggtgccattcctcgccggggaaacggtacgctggtccgttaaacaataa

SEQ ID NO: 392 - DNA, 1011 bp, Escherichia coli
atgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaa

SEQ ID NO: 393 - DNA, 642 bp, Escherichia coli
atgaaaccatatcagcgccagtttattgaatttgcgcttagcaagcaggtgttaaagtttggcgagtttacgctgaaatccgggcgcaaaagcccctatttcttcaacgccgggctgtttaataccgggcgcgatctggcactgttaggccgtttttacgctgaagcgttggtggattccggcattgagttcgatctgctgtttggccctgcttacaaagggatcccgattgccaccacaaccgctgtggcactggcggagcatcacgacctggacctgccgtactgctttaaccgcaaagaagcaaaagaccacggtgaaggcggcaatctggttggtagcgcgttacaaggacgcgtaatgctggtagatgatgtgatcaccgccggaacggcgattcgcgagtcgatggagattattcaggccaatggcgcgacgcttgctggcgtgttgatttcgctcgatcgtcaggaacgcgggcgcggcgagatttcggcgattcaggaagttgagcgtgattacaactgcaaagtgatctctatcatcaccctgaaagacctgattgcttacctggaagagaagccggaaatggcggaacatctggcggcggttaaggcctatcgcgaagagtttggcgtttaa

SEQ ID NO: 394 - DNA, 738 bp, Escherichia coli
atgacgttaactgcttcatcttcttcccgcgctgttacgaattctcctgtggttgttgcccttgattatcataatcgtgatgacgcgctggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatga

SEQ ID NO: 395 - DNA, 726 bp, Escherichia coli
atggctaccaatgcaaaacccgtctataaacgcattctgcttaagttgagtggcgaagctctgcagggcactgaaggcttcggtattgatgcaagcatactggatcgtatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttaccgctgatccggcgaaagatccaaccgcaaccatgtacgagcaactgacttacagcgaagtgctggaaaaagagctgaaagtcatggacctggcggccttcacgctggctcgtgaccataaattaccgattcgtgttttcaatatgaacaaaccgggtgcgctgcgccgtgtggtaatgggtgaaaaagaagggactttaatcacggaataa

SEQ ID NO: 396 - DNA, 1638 bp, Escherichia coli
atgacaacgaactatatttttgtgaccggcggggtcgtatcctctctgggtaaaggcattgccgcagcctccctcgcagccattcttgaagcccgtggcctcaatgtgaccatcatgaaactggatccgtacatcaacgtcgatccaggtactatgagcccaatccaacacggggaagtgttcgttactgaagacggcgctgaaaccgacctggacctggggcactacgagcgtttcattcgtaccaaaatgagccgccgcaacaacttcaccacgggtcgtatctactctgacgttctgcgtaaagaacgccgcggtgactacctcggcgcaaccgtgcaggttattccgcacatcactaacgcaatcaaagagcgcgtgctggaaggtggcgaaggtcatgacgtagtactggtagaaatcggcggtacagtaggtgatatcgaatccttgccgttcctcgaagcgattcgccagatggctgttgaaattggccgtgagcacactctgtttatgcacctgacgctggtgccgtacatggcagcgtctggtgaagtcaaaaccaaaccgactcagcactctgtaaaagagctgctctccatcggtatccagcctgacatcctgatttgtcgttcagatcgcgctgttccggcgaacgaacgtgcgaagattgcattgttctgtaatgttccggaaaaagcggttatttctctgaaagacgtcgattccatctataaaattccgggcctgttgaaatctcaggggctggacgattatatttgtaaacgattcagcttaaactgcccggaagcgaatctgtccgaatgggaacaggttatcttcgaagaagcgaacccggtaagtgaagtcaccatcggtatggtcggcaagtacattgaactgccggatgcttataaatcagtgatcgaagcactgaaacacggtgggctgaagaatcgtgtcagcgtcaacatcaaactgatcgattcacaagatgttgaaacgcgcggcgttgaaatccttaaaggtctggacgcaatcctcgtacctggcggtttcggctatcgtggcgtagaaggcatgattacgaccgcgcgttttgcgcgtgagaacaatattccttatctgggcatttgcctgggtatgcaggtggcgttaattgattacgctcgccatgttgccaacatggagaacgccaactctacggaatttgtgccagactgtaagtacccggttgtggcgctgattaccgagtggcgcgatgaaaacggcaacgttgaagttcgtagcgagaagagcgatctcggcggtaccatgcgtctcggcgcacagcagtgccagttggttgacgatagcctggttcgccagctgtacaatgcgccgacaattgttgagcgtcatcgtcaccgttacgaagtcaacaacatgctgttgaaacagattgaagatgcaggtctgcgcgttgcgggccgttccggggatgatcagttggtcgagatcatcgaagttccgaatcacccgtggttcgtggcttgccagttccatccggagtttacttctactccacgtgatggtcacccgctgtttgcaggctttgtgaaagccgccagcgagttccagaaacgtcaggcgaagtaa

SEQ ID NO: 397 - DNA, 1380 bp, Escherichia coli; identical to SEQ ID NO: 351

SEQ ID NO: 398 - protein, 321 aa, Escherichia coli
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEAIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDNPGLLGSGAHLRQTLGHIL

SEQ ID NO: 399 - protein, 549 aa, Escherichia coli
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 400 - protein, 491 aa, Escherichia coli
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 401 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 402 - protein, 225 aa, Escherichia coli
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAIFDQPDYKKVIDEMRSELAKVSHE

SEQ ID NO: 403 - protein, 219 aa, Escherichia coli
MTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 404 - protein, 149 aa, Escherichia coli
MKKIAFGCDHVGFILKHEIVAHLVERGVEVIDKGTWSSERTDYPHYASQVALAVAGGEVDGGILICGTGVGISIAANKFAGIRAVVCSEPYSAQLSRQHNDTNVLAFGSRVVGLELAKMIVDAWLGAQYEGGRHQQRVEAITAIEQRRN

SEQ ID NO: 405 - protein, 663 aa, Escherichia coli
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKELL

SEQ ID NO: 406 - protein, 667 aa, Escherichia coli
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 407 - protein, 316 aa, Escherichia coli
MNELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 408 - protein, 317 aa, Escherichia coli
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 409 - protein, 320 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 410 - protein, 309 aa, Escherichia coli
MVRIYTLTLAPSLDSATITPQIYPEGKLRCTAPVFEPGGGGINVARAIAHLGGSATAIFPAGGATGEHLVSLLADENVPVATVEAKDWTRQNLHVHVEASGEQYRFVMPGAALNEDEFRQLEEQVLEIESGAILVISGSLPPGVKLEKLTQLISAAQKQGIRCIVDSSGEALSAALAIGNIELVKPNQKELSALVNRELTQPDDVRKAAQEIVNSGKAKRVVVSLGPQGALGVDSENCIQVVPPPVKSQSTVGAGDSMVGAMTLKLAENASLEEMVRFGVAAGSAATLNQGTRLCSHDDTQKIYAYLSR

SEQ ID NO: 411 - protein, 359 aa, Escherichia coli
MSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 412 - protein, 350 aa, Escherichia coli [sequence omitted]

SEQ ID NO: 413 - protein, 255 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 414 - protein, 331 aa, Escherichia coli
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 415 - protein, 387 aa, Escherichia coli
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 416 - protein, 215 aa, Escherichia coli
MLQVYLVRHGETQWNAERRIQGQSDSPLTAKGEQQAMQVATRAKELGITHIISSDLGRTRRTAEIIAQACGCDIIFDSRLRELNMGVLEKRHIDSLTEEEENWRRQLVNGTVDGRIPEGESMQELSDRVNAALESCRDLPQGSRPLLVSHGIALGCLVSTILGLPAWAERRLRLRNCSISRVDYQESLWLASGWVVETAGDISHLDAPALDELQR

SEQ ID NO: 417 - protein, 250 aa, Escherichia coli
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 418 - protein, 514 aa, Escherichia coli
MLVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 419 - protein, 432 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 420 - protein, 480 aa, Escherichia coli
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 421 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 422 - protein, 474 aa, Escherichia coli [sequence omitted]

SEQ ID NO: 423 - protein, 887 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 424 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 425 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 426 - protein, 389 aa, Escherichia coli
MSDTTILQNSTHVIKPKKSVALSGVPAGNTALCTVGKSGNDLHYRGYDILDLAKHCEFEEVAHLLIHGKLPTRDELAAYKTKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPSQSWEKAMHISLVLYAEHEFNASTFTSRVIAGTGSDMYSAIIGAIGALRGPKHGGANEVSLEIQQRYETPDEAEADIRKRVENKEVVIGFGHPVYTIADPRHQVIKRVAKQLSQEGGSLKMYNIADRLETVMWESKKMFPNLDWFSAVSYNMMGVPTEMFTPLFVIARVTGWAAHIIEQRQDNKIIRPSANYVGPEDRPFVALDKRQ

SEQ ID NO: 427 - protein, 891 aa, Escherichia coli
MSSTLREASKDTLQAKDKTYHYYSLPLAAKSLGDITRLPKSLKVLLENLLRWQDGNSVTEEDIHALAGWLKNAHADREIAYRPARVLMQDFTGVPAVVDLAAMREAVKRLGGDTAKVNPLSPVDLVIDHSVTVDRFGDDEAFEENVRLEMERNHERYVFLKWGKQAFSRFSVVPPGTGICHQVNLEYLGKAVWSELQDGEWIAYPDTLVGTDSHTTMINGLGVLGWGVGGIEAEAAMLGQPVSMLIPDVVGFKLTGKLREGITATDLVLTVTQMLRKHGVVGKFVEFYGDGLDSLPLADRATIANMSPEYGATCGFFPIDAVTLDYMRLSGRSEDQVELVEKYAKAQGMWRNPGDEPIFTSTLELDMNDVEASLAGPKRPQDRVALPDVPKAFAASNELEVNATHKDRQPVDYVMNGHQYQLPDGAVVIAAITSCTNTSNPSVLMAAGLLAKKAVTLGLKRQPWVKASLAPGSKVVSDYLAKAKLTPYLDELGFNLVGYGCTTCIGNSGPLPDPIETAIKKSDLTVGAVLSGNRNFEGRIHPLVKTNWLASPPLVVAYALAGNMNINLASEPIGHDRKGDPVYLKDIWPSAQEIARAVEQVSTEMFRKEYAEVFEGTAEWKGINVTRSDTYGWQEDSTYIRLSPFFDEMQATPAPVEDIHGARILAMLGDSVTTDHISPAGSIKPDSPAGRYLQGRGVERKDFNSYGSRRGNHEVMMRGTFANIRIRNEMVPGVEGGMTRHLPDSDVVSIYDAAMRYKQEQTPLAVIAGKEYGSGSSRDWAAKGPRLLGIRVVIAESFERIHRSNLIGMGILPLEFPQGVTRKTLGLTGEEKIDIGDLQNLQPGATVPVTLTRADGSQEVVPCRCRIDTATELTYYQNDGILHYVIRNMLK

SEQ ID NO: 428 - protein, 865 aa, Escherichia coli
MLEEYRKHVAERAAEGIAPKPLDANQMAALVELLKNPPAGEEEFLLDLLTNRVPPGVDEAAYVKAGFLAAIAKGEAKSPLLTPEKAIELLGTMQGGYNIHPLIDALDDAKLAPIAAKALSHTLLMFDNFYDVEEKAKAGNEYAKQVMQSWADAEWFLNRPALAEKLTVTVFKVTGETNTDDLSPAPDAWSRPDIPLHALAMLKNAREGIEPDQPGVVGPIKQIEALQQKGFPLAYVGDVVGTGSSRKSATNSVLWFMGDDIPHVPNKRGGGLCLGGKIAPIFFNTMEDAGALPIEVDVSNLNMGDVIDVYPYKGEVRNHETGELLATFELKTDVLIDEVRAGGRIPLIIGRGLTTKAREALGLPHSDVFRQAKDVAESDRGFSLAQKMVGRACGVKGIRPGAYCEPKMTSVGSQDTTGPMTRDELKDLACLGFSADLVMQSFCHTAAYPKPVDVNTHHTLPDFIMNRGGVSLRPGDGVIHSWLNRMLLPDTVGTGGDSHTRFPIGISFPAGSGLVAFAAATGVMPLDMPESVLVRFKGKMQPGITLRDLVHAIPLYAIKQGLLTVEKKGKKNIFSGRILEIEGLPDLKVEQAFELTDASAERSAAGCTIKLNKEPIIEYLNSNIVLLKWMIAEGYGDRRTLERRIQGMEKWLANPELLEADADAEYAAVIDIDLADIKEPILCAPNDPDDARPLSAVQGEKIDEVFIGSCMTNIGHFRAAGKLLDAHKGQLPTRLWVAPPTRMDAAQLTEEGYYSVFGKSGARIEIPGCSLCMGNQARVADGATVVSTSTRNFPNRLGTGANVFLASAELAAVAALIGKLPTPEEYQTYVAQVDKTAVDTYRYLNFNQLSQYTEKADGVIFQTAV

SEQ ID NO: 429 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 430 - protein, 305 aa, Escherichia coli
MELIFLGTSAGVPTRTRNVTAILLNLQHPTQSGLWLFDCGEGTQHQLLHTAFNPGKLDKIFISHLHGDHLFGLPGLLCSRSMSGIIQPLTIYGPQGIREFVETALRISGSWTDYPLEIVEIGAGEILDDGLRKVTAYPLEHPLECYGYRIEEHDKPGALNAQALKAAGVPPGPLFQELKAGKTITLEDGRQINGADYLAAPVPGKALAIFGDTGPCDAALDLAKGVDVMVHEATLDITMEAKANSRGHSSTRQAATLAREAGVGKLIITHVSSRYDDKGCQHLLRECRSIFPATELANDFTVFNV

SEQ ID NO: 431 - protein, 933 aa, Escherichia coli
MQNSALKAWLDSSYLSGANQSWIEQLYEDFLTDPDSVDANWRSTFQQLPGTGVKPDQFHSQTREYFRRLAKDASRYSSTISDPDTNVKQVKVLQLINAYRFRGHQHANLDPLGLWQQDKVADLDPSFHDLTEADFQETFNVGSFASGKETMKLGELLEALKQTYCGPIGAEYMHITSTEEKRWIQQRIESGRATFNSEEKKRFLSELTAAEGLERYLGAKFPGAKRFSLEGGDALIPMLKEMIRHAGNSGTREVVLGMAHRGRLNVLVNVLGKKPQDLFDEFAGKHKEHLGTGDVKYHMGFSSDFQTDGGLVHLALAFNPSHLEIVSPVVIGSVRARLDRLDEPSSNKVLPITIHGDAAVTGQGVVQETLNMSKARGYEVGGTVRIVINNQVGFTTSNPLDARSTPYCTDIGKMVQAPIFHVNADDPEAVAFVTRLALDFRNTFKRDVFIDLVCYRRHGHNEADEPSATQPLMYQKIKKHPTPRKIYADKLEQEKVATLEDATEMVNLYRDALDAGDCVVAEWRPMNMHSFTWSPYLNHEWDEEYPNKVEMKRLQELAKRISTVPEAVEMQSRVAKIYGDRQAMAAGEKLFDWGGAENLAYATLVDEGIPVRLSGEDSGRGTFFHRHAVIHNQSNGSTYTPLQHIHNGQGAFRVWDSVLSEEAVLAFEYGYATAEPRTLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAVSSLEELANGTFLPAIGEIDELDPKGVKRVVMCSGKVYYDLLEQRRKNNQHDVAIVRIEQLYPFPHKAMQEVLQQFAHVKDFVWCQEEPLNQGAWYCSQHHFREVIPFGASLRYAGRPASASPAVGYMSVHQKQQQDLVNDALNVE

SEQ ID NO: 432 - protein, 405 aa, Escherichia coli
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEDPTRLLLDV

SEQ ID NO: 433 - protein, 388 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 434 - protein, 289 aa, Escherichia coli
MSILIDKNTKVICQGFTGSQGTFHSEQAIAYGTKMVGGVTPGKGGTTHLGLPVFNTVREAVAATGATASVIYVPAPFCKDSILEAIDAGIKLIITITEGIPTLDMLTVKVKLDEAGVRMIGPNCPGVITPGECKIGIQPGHIHKPGKVGIVSRSGTLTYEAVKQTTDYGFGQSTCVGIGGDPIPGSNFIDILEMFEKDPQTEAIVMIGEIGGSAEEEAAAYIKEHVTKPVVGYIAGVTAPKGKRMGHAGAIIAGGKGTADEKFAALEAAGVKTVRSLADIGEALKTVLK

SEQ ID NO: 435 - protein, 434 aa, Escherichia coli
MKTRTQQIEELQKEWTQPRWEGITRPYSAEDVVKLRGSVNPECTLAQLGAAKMWRLLHGESKKGYINSLGALTGGQALQQAKAGIEAVYLSGWQVAADANLAASMYPDQSLYPANSVPAVVERINNTFRRADQIQWSAGIEPGDPRYVDYFLPIVADAEAGFGGVLNAFELMKAMIEAGAAAVHFEDQLASVKKCGHMGGKVLVPTQEAIQKLVAARLAADVTGVPTLLVARTDADAADLITSDCDPYDSEFITGERTSEGFFRTHAGIEQAISRGLAYAPYADLVWCETSTPDLELARRFAQAIHAKYPGKLLAYNCSPSFNWQKNLDDKTIASFQQQLSDMGYKFQFITLAGIHSMWFNMFDLANAYAQGEGMKHYVEKVQQPEFAAAKDGYTFVSHQQEVGTGYFDKVTTIIQGGTSSVTALTGSTEESQF

SEQ ID NO: 436 - protein, 533 aa, Escherichia coli
MTEQATTTDELAFTRPYGEQEKQILTAEAVEFLTELVTHFTPQRNKLLAARIQQQQDIDNGTLPDFISETASIRDADWKIRGIPADLEDRRVEITGPVERKMVINALNANVKVFMADFEDSLAPDWNKVIDGQINLRDAVNGTISYTNEAGKIYQLKPNPAVLICRVRGLHLPEKHVTWRGEAIPGSLFDFALYFFHNYQALLAKGSGPYFYLPKTQSWQEAAWWSEVFSYAEDRFNLPRGTIKATLLIETLPAVFQMDEILHALRDHIVGLNCGRWDYIFSYIKTLKNYPDRVLPDRQAVTMDKPFLNAYSRLLIKTCHKRGAFAMGGMAAFIPSKDEEHNNQVLNKVKADKSLEANNGHDGTWIAHPGLADTAMAVFNDILGSRKNQLEVMREQDAPITADQLLAPCDGERTEEGMRANIRVAVQYIEAWISGNGCVPIYGLMEDAATAEISRTSIWQWIHHQKTLSNGKPVTKALFRQMLGEEMKVIASELGEERFSQGRFDDAARLMEQITTSDELIDFLTLPGYRLLA

SEQ ID NO: 437 - protein, 588 aa, Escherichia coli
MKLPVREFDAVVIGAGGAGMRAALQISQSGQTCALLSKVFPTRSHTVSAQGGITVALGNTHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYALDLVKNQDGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEKGEDVVVPGLFAVGEIACVSVHGANRLGGNSLLDLVVFGRAAGLHLQESIAEQGALRDASESDVEASLDRLNRWNNNRNGEDPVAIRKALQECMQHNFSVFREGDAMAKGLEQLKVIRERLKNARLDDTSSEFNTQRVECLELDNLMETAYATAVSANFRTESRGAHSRFDFPDRDDENWLCHSLYLPESESMTRRSVNMEPKLRPAFPPKIRTY

SEQ ID NO: 438 - protein, 238 aa, Escherichia coli
MRLEFSIYRYNPDVDDAPRMQDYTLEADEGRDMMLLDALIQLKEKDPSLSFRRSCREGVCGSDGLNMNGKNGLACITPISALNQPGKKIVIRPLPGLPVIRDLVVDMGQFYAQYEKIKPYLLNNGQNPPAREHLQMPEQREKLDGLYECILCACCSTSCPSFWWNPDKFIGPAGLLAAYRFLIDSRDTETDSRLDGLSDAFSVFRCHSIMNCVSVCPKGLNPTRAIGHIKSMLLQRNA

SEQ ID NO: 439 - protein, 129 aa, Escherichia coli [sequence omitted]

SEQ ID NO: 440 - protein, 115 aa, Escherichia coli
MVSNASALGRNGVHDFILVRATAIVLTLYIIYMVGFFATSGELTYEVWIGFFASAFTKVFTLLALFSILIHAWIGMWQVLTDYVKPLALRLMLQLVIVVALVVYVIYGFVVVWGV

SEQ ID NO: 441 - protein, 482 aa, Escherichia coli
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 442 - protein, 462 aa, Escherichia coli
MTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSQMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 443 - protein, 479 aa, Escherichia coli
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 444 - protein, 548 aa, Escherichia coli
MSNKPFHYQAPFPLKKDDTEYYLLTSEHVSVSEFEGQEILKVAPEALTLLARQAFHDASFMLRPAHQQQVADILRDPEASENDKYVALQFLRNSDIAAKGVLPTCQDTGTAIIVGKKGQRVWTGGGDEAALARGVYNTYIEDNLRYSQNAPLDMYKEVNTGTNLPAQIDLYAVDGDEYKFLCIAKGGGSANKTYLYQETKALLTPGKLKNYLVEKMRTLGTAACPPYHIAFVIGGTSAETNLKTVKLASAKYYDELPTEGNEHGQAFRDVELEKELLIEAQNLGLGAQFGGKYFAHDIRVIRLPRHGASCPVGMGVSCSADRNIKAKINRQGIWIEKLEHNPGKYIPEELRKAGEGEAVRVDLNRPMKEILAQLSQYPVSTRLSLNGTIIVGRDIAHAKLKERMDNGEGLPQYIKDHPIYYAGPAKTPEGYASGSLGPTTAGRMDSYVDQLQAQGGSMIMLAKGNRSQQVTDACKKHGGFYLGSIGGPAAVLAQGSIKSLECVEYPELGMEAIWKIEVEDFPAFILVDDKGNDFFQQIQLTQCTRCVK

SEQ ID NO: 445 - protein, 548 aa, Escherichia coli
MSNKPFIYQAPFPMGKDNTEYYLLTSDYVSVADFDGETILKVEPEALTLLAQQAFHDASFMLRPAHQKQVAAILHDPEASENDKYVALQFLRNSEIAAKGVLPTCQDTGTAIIVGKKGQRVWTGGGDEETLSKGVYNTYIEDNLRYSQNAALDMYKEVNTGTNLPAQIDLYAVDGDEYKFLCVAKGGGSANKTYLYQETKALLTPGKLKNFLVEKMRTLGTAACPPYHIAFVIGGTSAETNLKTVKLASAHYYDELPTEGNEHGQAFRDVQLEQELLEEAQKLGLGAQFGGKYFAHDIRVIRLPRHGASCPVGMGVSCSADRNIKAKINREGIWIEKLEHNPGQYIPQELRQAGEGEAVKVDLNRPMKEILAQLSQYPVSTRLSLTGTIIVGRDIAHAKLKELIDAGKELPQYIKDHPIYYAGPAKTPAGYPSGSLGPTTAGRMDSYVDLLQSHGGSMIMLAKGNRSQQVTDACHKHGGFYLGSIGGPAAVLAQQSIKHLECVAYPELGMEAIWKIEVEDFPAFILVDDKGNDFFQQIVNKQCANCTK

SEQ ID NO: 446 - protein, 420 aa, Escherichia coli
MNTVRSEKDSMGAIDVPADKLWGAQTQRSLEHFRISTEKMPTSLIHALALTKRAAAKVNEDLGLLSEEKASAIRQAADEVLAGQHDDEFPLAIWQTGSGTQSNMNMNEVLANRASELLGGVRGMERKVHPNDDVNKSQSSNDVFPTAMHVAALLALRKQLIPQLKTLTQTLNEKSRAFADIVKIGRTHLQDATPLTLGQEISGWVAMLEHNLKHIEYSLPHVAELALGGTAVGTGLNTHPEYARRVADELAVITCAPFVTAPNKFEALATCDALVQAHGALKGLAASLMKIANDVRWLASGPRCGIGEISIPENEPGSSIMPGKVNPTQCEALTMLCCQVMGNDVAINMGGASGNFELNVFRPMVIHNFLQSVRLLADGMESFNKHCAVGIEPNRERINQLLNESLMLVTALNTHIGYDK

SEQ ID NO: 447 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 448 - protein, 312 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGEEFVNK

SEQ ID NO: 449 - protein, 356 aa, Escherichia coli
MQKDALNNVHITDEQVLMTPEQLKAAFPLSLQQEAQIADSRKSISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 450 - protein, 350 aa, Escherichia coli
MNYQNDDLRIKEIKELLPPVALLEKFPATENAANTVAHARKAIHKILKGNDDRLLVVIGPCSIHDPVAAKEYATRLLALREELKDELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCADVCQQIAGGEKAIIGVMVESHLVEGNQSLESGEPLAYGKSITDACIGWEDTDALLRQLANAVKARRG

SEQ ID NO: 451 - protein, 348 aa, Escherichia coli
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGSQPLTYGQSITDPCLGWEDTERLVEKLASAVDTRF

SEQ ID NO: 452 - protein, 362 aa, Escherichia coli
MERIVVTLGERSYPITIASGLFNEPASFLPLKSGEQVMLVTNETLAPLYLDKVRGVLEQAGVNVDSVILPDGEQYKSLAVLDTVFTALLQKPHGRDTTLVALGGGVVGDLTGFAAASYQRGVRFIQVPTTLLSQVDSSVGGKTAVNHPLGKNMIGAFYQPASVVVDLDCLKTLPPRELASGLAEVIKYGIILDGAFFNWLEENLDALLRLDGPAMAYCIRRCCELKAEVVAADERETGLRALLNLGHTFGHAIEAEMGYGNWLHGEAVAAGMVMAARTSERLGQFSSAETQRIITLLKRAGLPVNGPREMSAQAYLPHMLRDKKVLAGEMRLILPLAIGKSEVRSGVSHELVLNAIADCQSA

SEQ ID NO: 453 - protein, 252 aa, Escherichia coli
MKTVTVKDLVIGTGAPKIIVSLMAKDIASVKSEALAYREADFDILEWRVDHYADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLAGEVFGSAATFGAVKKASAPGQISVNDLRTVLTILHQA

SEQ ID NO: 454 - protein, 288 aa, Escherichia coli
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTVTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 455 - protein, 272 aa, Escherichia coli
METYAVFGNPIAHSKSPFIHQQFAQQLNIEHPYGRVLAPINDFINTLNAFFSAGGKGANVTVPFKEEAFARADELTERAALAGAVNTLMRLEDGRLLGDNTDGVGLLSDLERLSFIRPGLRILLIGAGGASRGVLLPLLSLDCAVTITNRTVSRAEELAKLFAHTGSIQALSMDELEGHEFDLIINATSSGISGDIPAIPSSLIHPGIYCYDMFYQKGKTPFLAWCEQRGSKRNADGLGMLVAQAAHAFLLWHGVLPDVEPVIKQLQEELSA

SEQ ID NO: 456 - protein, 173 aa, Escherichia coli
MAEKRNIFLVGPMGAGKSTIGRQLAQQLNMEFYDSDQEIEKRTGADVGWVFDLEGEEGFRDREEKVINELTEKQGIVLATGGGSVKSRETRNRLSARGVVVYLETTIEKQLARTQRDKKRPLLHVETPPREVLEALANERNPLYEEIADVTIRTDDQSAKVVANQIIHMLESN

SEQ ID NO: 457 - protein, 174 aa, Escherichia coli
MTQPLFLIGPRGCGKTTVGMALADSLNRRFVDTDQWLQSQLNMTVAEIVEREEWAGFRARETAALEAVTAPSTVIATGGGIILTEFNRHFMQNNGIVVYLCAPVSVLVNRLQAAPEEDLRPTLTGKPLSEEVQEVLEERDALYREVAHIIIDATNEPSQVISEIRSALAQTINC

SEQ ID NO: 458 - protein, 427 aa, Escherichia coli
MESLTLQPIARVDGTINLPGSKSVSNRALLLAALAHGKTVLTNLLDSDDVRHMLNALTALGVSYTLSADRTRCEIIGNGGPLHAEGALELFLGNAGTAMRPLAAALCLGSNDIVLTGEPRMKERPIGHLVDALRLGGAKITYLEQENYPPLRLQGGFTGGNVDVDGSVSSQFLTALLMTAPLAPEDTVIRIKGDLVSKPYIDITLNLMKTFGVEIENQHYQQFVVKGGQSYQSPGTYLVEGDASSASYFLAAAAIKGGTVKVTGIGRNSMQGDIRFADVLEKMGATICWGDDYISCTRGELNAIDMDMNHIPDAAMTIATAALFAKGTTTLRNIYNWRVKETDRLFAMATELRKVGAEVEEGHDYIRITPPEKLNFAEIATYNDHRMAMCFSLVALSDTPVTILDPKCTAKTFPDYFEQLARISQAA

SEQ ID NO: 459 - protein, 361 aa, Escherichia coli
MAGNTIGQLFRVTTFGESHGLALGCIVDGVPPGIPLTEADLQHDLDRRRPGTSRYTTQRREPDQVKILSGVFEGVTTGTSIGLLIENTDQRSQDYSAIKDVFRPGHADYTYEQKYGLRDYRGGGRSSARETAMRVAAGAIAKKYLAEKFGIEIRGCLTQMGDIPLDIKDWSQVEQNPFFCPDPDKIDALDELMRALKKEGDSIGAKVTVVASGVPAGLGEPVFDRLDADIAHALMSINAVKGVEIGDGFDVVALRGSQNRDEITKDGFQSNHAGGILGGISSGQQIIAHMALKPTSSITVPGRTINRFGEEVEMITKGRHDPCVGIRAVPIAEAMLAIVLMDHLLRQRAQNADVKTDIPRW

SEQ ID NO: 460 - protein, 187 aa, Escherichia coli
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHNGEGVFRGLANPLTVTRYHSLVVEPDSLPACFDVTAWSETREIMGIRHRQWDLEGVQFHPESILSEQGHQLLANFLHR

SEQ ID NO: 461 - protein, 453 aa, Escherichia coli
MKTLSPAVITLLWRQDAAEFYFSRLSHLPWAMLLHSGYADHPYSRFDIVVAEPICTLTTFGKETVVSESEKRTTTTDDPLQVLQQVLDRADIRPTHNEDLPFQGGALGLFGYDLGRRFESLPEIAEQDIVLPDMAVGIYDWALIVDHQRHTVSLLSHNDVNARRAWLESQQFSPQEDFTLTSDWQSNMTREQYGEKFRQVQEYLHSGDCYQVNLAQRFHATYSGDEWQAFLQLNQANRAPFSAFLRLEQGAILSLSPERFILCDNSEIQTRPIKGTLPRLPDPQEDSKQAVKLANSAKDRAENLMIVDLMRNDIGRVAVAGSVKVPELFVVEPFPAVHHLVSTITAQLPEQLHASDLLRAAFPGGSITGAPKVRAMEIIDELEPQRRNAWCGSIGYLSFCGNMDTSITIRTLTAINGQIFCSAGGGIVADSQEEAEYQETFDKVNRILKQLEK

SEQ ID NO: 462 - protein, 373 aa, Escherichia coli
MVAELTALRDQIDEVDKALLNLLAKRLELVAEVGEVKSRFGLPIYVPEREASMLASRRAEAEALGVPPDLIEDVLRRVMRESYSSENDKGFKTLCPSLRPVVIVGGGGQMGRLFEKMLTLSGYQVRILEQHDWDRAADIVADAGMVIVSVPIHVTEQVIGKLPPLPKDCILVDLASVKNGPLQAMLVAHDGPVLGLHPMFGPDSGSLAKQVVVWCDGRKPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGEAIELLEQGDKQAFIDSFRKVEHWFGDYAQRFQSESRVLLRQANDNRQ

SEQ ID NO: 463 - protein, 386 aa, Escherichia coli
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSTINTVYSHPQPFQQCSKFLNRYPHWKIEYTESTSAAMEKVAQAKSPHVAALGSEAGGTLYGLQVLERIEANQRQNFTRFVVLARKAINVSDQVPAKTTLLMATGQQAGALVEALLVLRNHNLIMTRLESRPIHGNPWEEMFYLDIQANLESAEMQKALKELGEITRSMKVLGCYPSENVVPVDPT

SEQ ID NO: 464 - protein, 397 aa, Escherichia coli
MFQKVDAYAGDPILTLMERFKEDPRSDKVNLSIGLYYNEDGIIPQLQAVAEAEARLNAQPHGASLYLPMEGLNCYRHAIAPLLFGADHPVLKQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDAVIEILKARELIPFLDIAYQGFGAGMEEDAYAIRAIASAGLPALVSNSFSKIFSLYGERVGGLSVMCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 465 - protein, 396 aa, Escherichia coli; identical to SEQ ID NO: 447

SEQ ID NO: 466 - protein, 290 aa, Escherichia coli
MEWSLTQNKLLAFHRLMRTDKPIGALLLLWPTLWALWVATPGVPQLWILAVFVAGVWLMRAAGCVVNDYADRKFDGHVKRTANRPLPSGAVTEKEARALFVVLVLISFLLVLTLNTMTILLSIAALALAWVYPFMKRYTHLPQVVLGAAFGWSIPMAFAAVSESVPLSCWLMFLANILWAVAYDTQYAMVDRDDDVKIGIKSTAILFGQYDKLIIGILQIGVLALMAIIGELNGLGWGYYWSILVAGALFVYQQKLIANREREACFKAFMNNNYVGLVLFLGLAMSYWHF

SEQ ID NO: 467 - protein, 165 aa, Escherichia coli
MSHPALTQLRALRYCKEIPALDPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPASPLY

SEQ ID NO: 468 - protein, 189 aa, Escherichia coli
MKRLIVGISGASGAIYGVRLLQVLRDVTDIETHLVMSQAARQTLSLETDFSLREVQALADVTHDARDIAASISSGSFQTLGMVILPCSIKTLSGIVHSYTDGLLTRAADVVLKERRPLVLCVRETPLHLGHLRLMTQAAEIGAVIMPPVPAFYHRPQSLDDVINQTVNRVLDQFAITLPEDLFARWQGA

SEQ ID NO: 469 - protein, 497 aa, Escherichia coli
MDAMKYNDLRDFLTLLEQQGELKRITLPVDPHLEITEIADRTLRAGGPALLFENPKGYSMPVLCNLFGTPKRVAMGMGQEDVSALREVGKLLAFLKEPEPPKGFRDLFDKLPQFKQVLNMPTKRLRGAPCQQKIVSGDDVDLNRIPIMTCWPEDAAPLITWGLTVTRGPHKERQNLGIYRQQLIGKNKLIMRWLSHRGGALDYQEWCAAHPGERFPVSVALGADPATILGAVTPVPDTLSEYAFAGLLRGTKTEVVKCISNDLEVPASAEIVLEGYIEQGETAPEGPYGDHTGYYNEVDSFPVFTVTHITQREDAIYHSTYTGRPPDEPAVLGVALNEVFVPILQKQFPEIVDFYLPPEGCSYRLAVVTIKKQYAGHAKRVMMGVWSFLRQFMYTKFVIVCDDDVNARDWNDVIWAITTRMDPARDTVLVENTPIDYLDFASPVSGLGSKMGLDATNKWPGETQREWGRPIKKDPDVVAHIDAIWDELAIFNNGKSA

SEQ ID NO: 470 - protein, 546 aa, Escherichia coli
MTPGEVRRLYFIIRTFLSYGLDELIPKMRITLPLRLWRYSLFWMPNRHKDKLLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVAALEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 471 - protein, 240 aa, Escherichia coli
MNAEKSPVNHNVDHEEIAKFEAVASRWWDLEGEFKPLHRINPLRLGYIAERAGGLFGKKVLDVGCGGGILAESMAREGATVTGLDMGFEPLQVAKLHALESGIQVDYVQETVEEHAAKHAGQYDVVTCMEMLEHVPDPQSVVRACAQLVKPGGDVFFSTLNRNGKSWLMAVVGAEYILRMVPKGTHDVKKFIKPAELLGWVDQTSLKERHITGLHYNPITNTFKLGPGVDVNYMLHTQNK

SEQ ID NO: 472 - protein, 392 aa, Escherichia coli [sequence omitted]

SEQ ID NO: 473 - protein, 251 aa, Escherichia coli
MVDKSQETTHFGFQTVAKEQKADMVAHVFHSVASKYDVMNDLMSFGIHRLWKRFTIDCSGVRRGQTVLDLAGGTGDLTAKFSRLVGETGKVVLADINESMLKMGREKLRNIGVIGNVEYVQANAEALPFPDNTFDCITISFGLRNVTDKDKALRSMYRVLKPGGRLLVLEFSKPIIEPLSKAYDAYSFHVLPRIGSLVANDADSYRYLAESIRMHPDQDTLKAMMQDAGFESVDYYNLTAGVVALHRGYKF

SEQ ID NO: 474 - protein, 391 aa, Escherichia coli
MTNQPTEIAIVGGGMVGGALALGLAQHGFAVTVIEHAEPAPFVADSQPDVRISAISAASVSLLKGLGVWDAVQAMRCHPYRRLETWEWETAHVVFDAAELKLPLLGYMVENTVLQQALWQALEAHPKVTLRVPGSLIALHRHDDLQELELKGGEVIRAKLVIGADGANSQVRQMAGIGVHAWQYAQSCMLISVQCENDPGDSTWQQFTPDGPRAFLPLFDNWASLVWYDSPARIRQLQNMNMAQLQAEIAKHFPSRLGYVTPLAAGAFPLTRRHALQYVQPGLALVGDAAHTIHPLAGQGVNLGYRDVDALIDVLVNARSYGEAWASYPVLKRYQMRRMADNFIMQSGMDLFYAGFSNNLPPLRFMRNLGLMAAERAGVLKRQALKYALGL

SEQ ID NO: 475 - protein, 531 aa, Escherichia coli
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPANTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 476 - protein, 520 aa, Escherichia coli
MQTQKPTLELLTCEGAYRDNPTALFHQLCGDRPATLLLESADIDSKDDLKSLLLVDSALRITALGDTVTIQALSGNGEALLALLDNALPAGVESEQSPNCRVLRFPPVSPLLDEDARLCSLSVFDAFRLLQNLLNVPKEEREAMFFGGLFSYDLVAGFEDLPQLSAENNCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 477 - protein, 452 aa, Escherichia coli
MQTVLAKIVADKAIWVEARKQQQPLASFQNEVQPSTRHFYDALQGARTAFILECKKASPSKGVIRDDFDPARIAAIYKHYASAISVLTDEKYFQGSFNFLPIVSQIAPQPILCKDFIIDPYQIYLARYYQADACLLMLSVLDDDQYRQLAAVAHSLEMGVLTEVSNEEEQERAIALGAKVVGINNRDLRDLSIDLNRTRELAPKLGHNVTVISESGINTYAQVRELSHFANGFLIGSALMAHDDLHAAVRRVLLGENKVCGLTRGQDAKAAYDAGAIYGGLIFVATSPRCVNVEQAQEVMAAAPLQYVGVFRNHDIADVVDKAKVLSLAAVQLHGNEEQLYIDTLREALPAHVAIWKALSVGETLPAREFQHVDKYVLDNGQGGSGQRFDWSLLNGQSLGNVLLAGGLGADNCVEAAQTGCAGLDFNSAVESQPGIKDARLLASVFQTLRAY

SEQ ID NO: 478 - protein, 268 aa, Escherichia coli
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKVFVQPMKAATRS

SEQ ID NO: 479 - protein, 397 aa, Escherichia coli [sequence omitted]

SEQ ID NO: 480 - protein, 431 aa, Escherichia coli
MQSLTTALENLLRHLSQEIPATPGIRVIDIPFPLKDAFDALSWLASQQTYPQFYWQQRNGDEEAVVLGAITRFTSLDQAQRFLRQHPEHADLRIWGLNAFDPSQGNLLLPRLEWRRCGGKATLRLTLFSESSLQHDAIQAKEFIATLVSIKPLPGLHLTTTREQHWPDKTGWTQLIELATKTIAEGELDKVVLARATDLHFASPVNAAAMMAASRRLNLNCYHFYMAFDGENAFLGSSPERLWRRRDKALRTEALAGTVANNPDDKQAQQLGEWLMADDKNQRENMLVVEDICQRLQADTQTLDVLPPQVLRLRKVQHLRRCIWTSLNKADDVICLHQLQPTAAVAGLPRDLARQFIARHEPFTREWYAGSAGYLSLQQSEFCVSLRSAKISGNVVRLYAGAGIVRGSDPEQEWQEIDNKAAGLRTLLQME

SEQ ID NO: 481 - protein, 391 aa, Escherichia coli
MDTSLAEEVQQTMATLAPNRFFFMSPYRSFTTSGCFARFDEPAVNGDSPDSPFQQKLAALFADAKAQGIKNPVMVGAIPFDPRQPSSLYIPESWQSFSRQEKQASARRFTRSQSLNVVERQAIPEQTTFEQMVARAAALTATPQVDKVVLSRLIDITTDAAIDSGVLLERLIAQNPVSYNFHVPLADGGVLLGASPELLLRKDGERFSSIPLAGSARRQPDEVLDREAGNRLLASEKDRHEHELVTQAMKEVLRERSSELHVPSSPQLITTPTLWHLATPFEGKANSQENALTLACLLHPTPALSGFPHQAATQVIAELEPFDRELFGGIVGWCDSEGNGEWVVTIRCAKLRENQVRLFAGAGIVPASSPLGEWRETGVKLSTMLNVFGLH

SEQ ID NO: 482 - protein, 536 aa, Escherichia coli
MSIPFTRWPEEFARRYREKGYWQDLPLTDILTRHAASDSIAVIDGERQLSYRELNQAADNLACSLRRQGIKPGETALVQLGNVAELYITFFALLKLGVAPVLALFSHQRSELNAYASQIEPALLIADRQHALFSGDDFLNTFVTEHSSIRVVQLLNDSGEHNLQDAINHPAEDFTATPSPADEVAYFQLSGGTTGTPKLIPRTHNDYYYSVRRSVEICQFTQQTRYLCAIPAAHNYAMSSPGSLGVFLAGGTVVLAADPSATLCFPLIEKHQVNVTALVPPAVSLWLQALIEGESRAQLASLKLLQVGGARLSATLAARIPAEIGCQLQQVFGMAEGLVNYTRLDDSAEKIIHTQGYPMCPDDEVWVADAEGNPLPQGEVGRLMTRGPYTFRGYYKSPQHNASAFDANGFYCSGDLISIDPEGYITVQGREKDQINRGGEKIAAEEIENLLLRHPAVIYAALVSMEDELMGEKSCAYLVVKEPLRAVQVRRFLREQGIAEFKLPDRVECVDSLPLTAVGKVDKKQLRQWLASRASA

SEQ ID NO: 483 - protein, 1293 aa, Escherichia coli
MSQHLPLVAAQPGIWMAEKLSELPSAWSVAHYVELTGEVDSPLLARAVVAGLAQADTLRMRFTEDNGEVWQWVDDALTFELPEIIDLRTNIDPHGTAQALMQADLQQDLRVDSGKPLVFHQLIQVADNRWYWYQRYHHLLVDGFSFPAITRQIANIYCTWLRGEPTPASPFTPFADVVEEYQQYRESEAWQRDAAFWAEQRRQLPPPASLSPAPLPGRSASADILRLKLEFTDGEFRQLATQLSGVQRTDLALALAALWLGRLCNRMDYAAGFIFMRRLGSAALTATGPVLNVLPLGIHIAAQETLPELATRLAAQLKKMRRHQRYDAEQIVRDSGRAAGDEPLFGPVLNIKVFDYQLDIPDVQAQTHTLATGPVNDLELALFPDVHGDLSIEILANKQRYDEPTLIQHAERLKMLIAQFAADPALLCGDVDIMLPGEYAQLAQLNATQVEIPETTLSALVAEQAAKTPDAPALADARYLFSYREMREQVVALANLLRERGVKPGDSVAVALPRSVFLTLALHAIVEAGAAWLPLDTGYPDDRLKMMLEDARPSLLITTDDQLPRFSDVPNLTSLCYNAPLTPQGSAPLQLSQPHHTAYIIFTSGSTGRPKGVMVGQTAIVNRLLWMQNHYPLTGEDVVAQKTPCSFDVSVWEFFWPFIAGAKLVMAEPEAHRDPLAMQQFFAEYGVTTTHFVPSMLAAFVASLTPQTARQSCATLKQVFCSGEALPADLCREWQQLTGAPLHNLYGPTEAAVDVSWYPAFGEELAQVRGSSVPIGYPVWNTGLRILDAMMHPVPPGVAGDLYLTGIQLAQGYLGRPDLTASRFIADPFAPGERMYRTGDVARWLDNGAVEYLGRSDDQLKIRGQRIELGEIDRVMQALPDVEQAVTHACVINQAAATGGDARQLVGYLVSQSGLPLDTSALQAQLRETLPPHMVPVVLLQLPQLPLSANGKLDRKALPLPELKAQAPGRAPKAGSETIIAAAFSSLLGCDVQDADADFFALGGHSLLAMKLAAQLSRQVARQVTPGQVMVASTVAKLATIIDAEEDSTRRMGFETILPLREGNGPTLFCFHPASGFAWQFSVLSRYLDPQWSIIGIQSPRPNGPMQTAANLDEVCEAHLATLLEQQPHGPYYLLGYSLGGTLAQGIAARLRARGEQVAFLGLLDTWPPETQNWQEKEANGLDPEVLAEINREREAFLAAQQGSTSTELFTTIEGNYADAVRLLTTAHSVPFDGKATLFVAERTLQEGMSPERAWSPWIAELDIYRQDCAHVDIISPGTFEKIGPIIRATLNR

SEQ ID NO: 484 - protein, 209 aa, Escherichia coli
MVDMKTTHTSLPFAGHTLHFVEFDPANFCEQDLLWLPHYAQLQHAGRKRKTEHLAGRIAAVYALREYGYKCVPAIGELRQPVWPAEVYGSISHCGTTALAVVSRQPIGIDIEEIFSVQTARELTDNIITPAEHERLADCGLAFSLALTLAFSAKESAFKASEIQTDAGFLDYQIISWNKQQVIIHRENEMFAVHWQIKEKIVITLCQHD

SEQ ID NO: 485 - protein, 285 aa, Escherichia coli
MAIPKLQAYALPESHDIPQNKVDWAFEPQRAALLIHDMQDYFVSFWGENCPMMEQVIANIAALRDYCKQHNIPVYYTAQPKEQSDEDRALLNDMWGPGLTRSPEQQKVVDRLTPDADDTVLVKWRYSAFHRSPLEQMLKESGRNQLIITGVYAHIGCMTTATDAFMRDIKPFMVADALADFSRDEHLMSLKYVAGRSGRVVMTEELLPAPIPASKAALREVILPLLDESDEPFDDDNLIDYGLDSVRMMALAARWRKVHGDIDFVMLAKNPTIDAWWKLLSREVK

SEQ ID NO: 486 - protein, 556 aa, Escherichia coli
MSVSAFNRRWAAVILEALTRHGVRHICIAPGSRSTPLTLAAAENSAFIHHTHFDERGLGHLALGLAKVSKQPVAVIVTSGTAVANLYPALIEAGLTGEKLILLTADRPPELIDCGANQAIRQPGMFASHPTHSISLPRPTQDIPARWLVSTIDHALGTLHAGGVHINCPFAEPLYGEMDDTGLSWQQRLGDWWQDDKPWLREAPRLESEKQRDWFFWRQKRGVVVAGRMSAEEGKKVALWAQTLGWPLIGDVLSQTGQPLPCADLWLGNAKATSELQQAQIVVQLGSSLTGKRLLQWQASCEPEEYWIVDDIEGRLDPAHHRGRRLIANIADWLELHPAEKRQPWCVEIPRLAEQAMQAVIARRDAFGEAQLAHRICDYLPEQGQLFVGNSLVVRLIDALSQLPAGYPVYSNRGASGIDGLLSTAAGVQRASGKPTLAIVGDLSALYDLNALALLRQVSAPLVLIVVNNNGGQIFSLLPTPQSERERFYLMPQNVHFEHAAAMFELKYHRPQNWQELETAFADAWRTPTTTVIEMVVNDTDGAQTLQQLLAQVSHL

SEQ ID NO: 487 - protein, 252 aa, Escherichia coli
MILHAQAKHGKPGLPWLVFLHGFSGDCHEWQEVGEAFADYSRLYVDLPGHGGSAAISVDGFDDVTDLLRKTLVSYNILDFWLVGYSLGGRVAMMAACQGLAGLCGVIVEGGHPGLQNAEQRAERQRSDRQWVQRFLTEPLTAVFADWYQQPVFASLNDDQRRELVALRSNNNGATLAAMLEATSLAVQPDLRANLSARTFAFYYLCGERDSKFRALAAELAADCHVIPRAGHNAHRENPAGVIASLAQILRF

SEQ ID NO: 488 - protein, 320 aa, Escherichia coli
MRSAQVYRWQIPMDAGVVLRDRRLKTRDGLYVCLREGEREGWGEISPLPGFSQETWEEAQSVLLAWVNNWLAGDCELPQMPSVAFGVSCALAELTDTLPQAANYRAAPLCNGDPDDLILKLADMPGEKVAKVKVGLYEAVRDGMVVNLLLEAIPDLHLRLDANRAWTPLKGQQFAKYVNPDYRDRIAFLEEPCKTRDDSRAFARETGIAIAWDESLREPDFAFVAEEGVRAVVIKPTLTGSLEKVREQVQAAHALGLTAVISSSIESSLGLTQLARIAAWLTPDTIPGLDTLDLMQAQQVRRWPGSTLPVVEVDALERLL

SEQ ID NO: 489 - protein, 451 aa, Escherichia coli
MIFSDWPWRHWRQVRGETIALRLNDEQLNWRELCARVDELASGFAVQGVVEGSGVMLRAWNTPQTLLAWLALLQCGARVLPVNPQLPQPLLEELLPNLTLQFALVPDGENTFPALTSLHIQLVEGAHAATWQPTRLCSMTLTSGSTGLPKAAVHTYQAHLASAQGVLSLIPFGDHDDWLLSLPLFHVSGQGIMWRWLYAGARMTVRDKQPLEQMLAGCTHASLVPTQLWRLLVNRSSVSLKAVLLGGAAIPVELTEQAREQGIRCFCGYGLTEFASTVCAKEADGLADVGSPLPGREVKIVNNEVWLRAASMAEGYWRNGQLVSLVNDEGWYATRDRGEMHNGKLTIVGRLDNLFFSGGEGIQPEEVERVIAAHPAVLQVFIVPVADKEFGHRPVAVMEYDHESVDLSEWVKDKLARFQQPVRWLTLPPELKNGGIKISRQALKEWVQRQQ

SEQ ID NO: 490 - protein, 285 aa, Escherichia coli
MIYPDEAMLYAPVEWHDCSEGFEDIRYEKSTDGIAKITINRPQVRNAFRPLTVKEMIQALADARYDDNIGVIILTGAGDKAFCSGGDQKVRGDYGGYKDDSGVHHLNVLDFQRQIRTCPKPVVAMVAGYSIGGGHVLHMMCDLTIAADNAIFGQTGPKVGSFDGGWGASYMARIVGQKKAREIWFLCRQYDAKQALDMGLVNTVVPLADLEKETVRWCREMLQNSPMALRCLKAALNADCDGQAGLQELAGNATMLFYMTEEGQEGRNAFNQKRQPDFSKFKRNP

SEQ ID NO: 491 - protein, 308 aa, Escherichia coli
MTEQQISRTQAWLESLRPKTLPLAFAAIIVGTALAWWQGHFDPLVALLALITAGLLQILSNLANDYGDAVKGSDKPDRIGPLRGMQKGVITQQEMKRALIITVVLICLSGLALVAVACHTLADFVGFLILGGLSIIAAITYTVGNRPYGYIGLGDISVLVFFGWLSVMGSWYLQAHTLIPALILPATACGLLATAVLNINNLRDINSDRENGKNTLVVRLGEVNARRYHACLLMGSLVCLALFNLFSLHSLWGWLFLLAAPLLVKQARYVMREMDPVAMRPMLERTVKGALLTNLLFVLGIFLSQWAA

SEQ ID NO: 492 - protein, 222 aa, Escherichia coli
MPSLSKEAALVHEALVARGLETPLRPPVHEMDNETRKSLIAGHMTEIMQLLNLDLADDSLMETPHRIAKMYVDEIFSGLDYANFPKITLIENKMKVDEMVTVRDITLTSTCEHHFVTIDGKATVAYIPKDSVIGLSKINRIVQFFAQRPQVQERLTQQILIALQTLLGTNNVAVSIDAVHYCVKARGIRDATSATTTTSLGGLFKSSQNTRHEFLRAVRHHN

SEQ ID NO: 493 - protein, 150 aa, Escherichia coli
MKDKVYKRPVSILVVIYAQDTKRVLMLQRRDDPDFWQSVTGSVEEGETAPQAAMREVKEEVTIDVVAEQLTLIDCQRTVEFEIFSHLRHRYAPGVTRNTESWFCLALPHERQIVFTEHLAYKWLDAPAAAALTKSWSNRQAIEQFVINAA

SEQ ID NO: 494 - protein, 122 aa, Escherichia coli
MDIVFIEQLSVITTIGVYDWEQTIEQKLVFDIEMAWDNRKAAKSDDVADCLSYADIAETVVSHVEGARFALVERVAEEVAELLLARFNSPWVRIKLSKPGAVARAANVGVIIERGNNLKENN

SEQ ID NO: 495 - protein, 159 aa, Escherichia coli
MTVAYIAIGSNLASPLEQVNAALKALGDIPESHILTVSSFYRTPPLGPQDQPDYLNAAVALETSLAPEELLNHTQRIELQQGRVRKAERWGPRTLDLDIMLFGNEVINTERLTVPHYDMKNRGFMLWPLFEIAPELVFPDGEMLRQILHTRAFDKLNKW

SEQ ID NO: 496 - protein, 269 aa, Escherichia coli [sequence omitted]

SEQ ID NO: 497 - protein, 282 aa, Escherichia coli
MKLFAQGTSLDLSHPHVMGILNVTPDSFSDGGTHNSLIDAVKHANLMINAGATIIDVGGESTRPGAAEVSVEEELQRVIPVVEAIAQRFEVWISVDTSKPEVIRESAKVGAHIINDIRSLSEPGALEAAAETGLPVCLMHMQGNPKTMQEAPKYDDVFAEVNRYFIEQIARCEQAGIAKEKLLLDPGFGFGKNLSHNYSLLARLAEFHHFNLPLLVGMSRKSMIGQLLNVGPSERLSGSLACAVIAAMQGAHIIRVHDVKETVEAMRVVEATLSAKENKRYE

SEQ ID NO: 498 - protein, 422 aa, Escherichia coli
MIIKRTPQAASPLASWLSYLENLHSKTIDLGLERVSLVAARLGVLKPAPFVFTVAGTNGKGTTCRTLESILMAAGYKVGVYSSPHLVRYTERVRVQGQELPESAHTASFAEIESARGDISLTYFEYGTLSALWLFKQAQLDVVILEVGLGGRLDATNIVDADVAVVTSIALDHTDWLGPDRESIGREKAGIFRSEKPAIVGEPEMPSTIADVAQEKGALLQRRGVEWNYSVTDHDWAFSDAHGTLENLPLPLVPQPNAATALAALRASGLEVSENAIRDGIASAILPGRFQIVSESPRVIFDVAHNPHAAEYLTGRMKALPKNGRVLAVIGMLHDKDIAGTLAWLKSVVDDWYCAPLEGPRGATAEQLLEHLGNGKSFDSVAQAWDAAMADAKAEDTVLVCGSFHTVAHVMEVIDARRSGGK

SEQ ID NO: 499 - protein, 159 aa, Escherichia coli [sequence omitted]

SEQ ID NO: 500 - protein, 240 aa, Escherichia coli
MGKTQPLPILITGGGRRIGLALAWHFINQKQPVIVSYRTHYPAIDGLINAGAQCIQADFSTNDGVMAFADEVLKSTHGLRAILHNASAWMAEKPGAPLADVLACMMQIHVNTPYLLNHALERLLRGHGHAASDIIHFTDYVVERGSDKHIAYAASKAALDNMTRSFARKLAPEVKVNSIAPSLILFNEHDDAEYRQQALNKSLMKTAPGEKEVIDLVDYLLTSCFVTGRSFPLDGGRHLR

SEQ ID NO: 501 - protein, 212 aa, Escherichia coli
MNIVVLISGNGSNLQAIIDACKTNKIKGTVRAVFSNKADAFGLERARQAGIATHTLIASAFDSREAYDRELIHEIDMYAPDVVVLAGFMRILSPAFVSHYAGRLLNIHPSLLPKYPGLHTHRQALENGDEEHGTSVHFVTDELDGGPVILQAKVPVFAGDSEDDITARVQTQEHAIYPLVISWFADGRLKMHENAAWLDGQRLPPQGYAADE

SEQ ID NO: 502 - protein, 288 aa, Escherichia coli
MAAKIIDGKTIAQQVRSEVAQKVQARIAAGLRAPGLAVVLVGSNPASQIYVASKRKACEEVGFVSRSYDLPETTSEAELLELIDTLNADNTIDGILVQLPLPAGIDNVKVLERIHPDKDVDGFHPYNVGRLCQRAPRLRPCTPRGIVTLLERYNIDTFGLNAVVIGASNIVGRPMSMELLLAGCTTTVTHRFTKNLRHHVENADLLIVAVGKPGFIPGDWIKEGAIVIDVGINRLENGKVVGDVVFEDAAKRASYITPVPGGVGPMTVATLIENTLQACVEYHDPQDE

SEQ ID NO: 503 - protein, 440 aa, Escherichia coli
MVQCVRHFVLPRLKKDAGLPFFFPLITHSQPLNRGAFFCPGVRRMFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 504 - protein, 311 aa, Escherichia coli
MANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVL

SEQ ID NO: 505 - protein, 449 aa, Escherichia coli
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFE

SEQ ID NO: 506 - protein, 810 aa, Escherichia coli
MSVIAQAGAKGRQLHKFGGSSLADVKCYLRVAGIMAEYSQPDDMMVVSAAGSTTNQLINWLKLSQTDRLSAHQVQQTLRRYQCDLISGLLPAEEADSLISAFVSDLERLAALLDSGINDAVYAEVVGHGEVWSARLMSAVLNQQGLPAAWLDAREFLRAERAAQPQVDEGLSYPLLQQLLVQHPGKRLVVTGFISRNNAGETVLLGRNGSDYSATQIGALAGVSRVTIWSDVAGVYSADPRKVKDACLLPLLRLDEASELARLAAPVLHARTLQPVSGSEIDLQLRCSYTPDQGSTRIERVLASGTGARIVTSHDDVCLIEFQVPASQDFKLAHKEIDQILKRAQVRPLAVGVHNDRQLLQFCYTSEVADSALKILDEAGLPGELRLRQGLALVAMVGAGVTRNPLHCHRFWQQLKGQPVEFTWQSDDGISLVAVLRTGPTESLIQGLHQSVFRAEKRIGLVLFGKGNIGSRWLELFAREQSTLSARTGFEFVLAGVVDSRRSLLSYDGLDASRALAFFNDEAVEQDEESLFLWMRAHPYDDLVVLDVTASQQLADQYLDFASHGFHVISANKLAGASDSNKYRQIHDAFEKTGRHWLYNATVGAGLPINHTVRDLIDSGDTILSISGIFSGTLSWLFLQFDGSVPFTELVDQAWQQGLTEPDPRDDLSGKDVMRKLVILAREAGYNIEPDQVRVESLVPAHCEGGSIDHFFENGDELNEQMVQRLEAAREMGLVLRYVARFDANGKARVGVEAVREDHPLASLLPCDNVFAIESRWYRDNPLVIRGPGAGRDVTAGAIQSDINRLAQLL

SEQ ID NO: 507 - protein, 820 aa, Escherichia coli
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 508 - protein, 367 aa, Escherichia coli
MKNVGFIGWRGMVGSVLMQRMVEERDFDAIRPVFFSTSQLGQAAPSFGGTTGTLQDAFDLEALKALDIIVTCQGGDYTNEIYPKLRESGWQGYWIDAASSLRMKDDAIIILDPVNQDVITDGLNNGIRTFVGGNCTVSLMLMSLGGLFANDLVDWVSVATYQAASGGGARHMRELLTQMGHLYGHVADELATPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVEELLAAHNPWAKVVPNDREITMRELTPAAVTGTLTTPVGRLRKLNMGPEFLSAFTVGDQLLWGAAEPLRRMLRQLA

SEQ ID NO: 509 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 510 - protein, 309 aa, Escherichia coli [sequence omitted]

SEQ ID NO: 511 - protein, 386 aa, Escherichia coli
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 512 - protein, 303 aa, Escherichia coli
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 513 - protein, 323 aa, Escherichia coli
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 514 - protein, 390 aa, Escherichia coli
MFDFSKVVDRHGTWCTQWDYVADRFGTADLLPFTISDMDFATAPCIIEALNQRLMHGVFGYSRWKNDEFLAAIAHWFSTQHYTAIDSQTVVYGPSVIYMVSELIRQWSETGEGVVIHTPAYDAFYKAIEGNQRTVMPVALEKQADGWFCDMGKLEAVLAKPECKIMLLCSPQNPTGKVWTCDELEIMADLCERHGVRVISDEIHMDMVWGEQPHIPWSNVARGDWALLTSGSKSFNIPALTGAYGIIENSSSRDAYLSALKGRDGLSSPSVLALTAHIAAYQQGAPWLDALRIYLKDNLTYIADKMNAAFPELNWQIPQSTYLAWLDLRPLNIDDNALQKALIEQEKVAIMPGYTYGEEGRGFVRLNAGCPRSKLEKGVAGLINAIRAVR

SEQ ID NO: 515 - protein, 395 aa, Escherichia coli
MADKKLDTQLVNAGRSKKYTLGAVNSVIQRASSLVFDSVEAKKHATRNRANGELFYGRRGTLTHFSLQQAMCELEGGAGCVLFPCGAAAVANSILAFIEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNNEELANYLDNFSLFSMAYSWGGYESLILANQPEHIAAIRPQGEIDFSGTLIRLHIGLEDVDDLIADLDAGFARIV

SEQ ID NO: 516 - protein, 753 aa, Escherichia coli
MTILNHTLGFPRVGLRRELKKAQESYWAGNSTREELLAVGRELRARHWDQQKQAGIDLLPVGDFAWYDHVLTTSLLLGNVPARHQNKDGSVDIDTLFRIGRGRAPTGEPAAAAEMTKWFNTNYHYMVPEFVKGQQFKLTWTQLLDEVDEALALGHKVKPVLLGPVTWLWLGKVKGEQFDRLSLLNDILPVYQQVLAELAKRGIEWVQIDEPALVLELPQAWLDAYKPAYDALQGQVKLLLTTYFEGVTPNLDTITALPVQGLHVDLVHGKDDVAELHKRLPSDWLLSAGLINGRNVWRADLTEKYAQIKDIVGKRDLWVASSCSLLHSPIDLSVETRLDAEVKSWFAFALQKCHELALLRDALNSGDTAALAEWSAPIQARRHSTRVHNPAVEKRLAAITAQDSQRANVYEVRAEAQRARFKLPAWPTTTIGSFPQTTEIRTLRLDFKKGNLDANNYRTGIAEHIKQAIVEQERLGLDVLVHGEAERNDMVEYFGEHLDGFVFTQNGWVQSYGSRCVKPPIVIGDISRPAPITVEWAKYAQSLTDKPVKGMLTGPVTILCWSFPREDVSRETIAKQIALALRDEVADLEAAGIGIIQIDEPALREGLPLRRSDWDAYLQWGVEAFRINAAVAKDDTQIHTHMCYCEFNDIMDSIAALDADVITIETSRSDMELLESFEEFDYPNEIGPGVYDIHSPNVPSVEWIEALLKKAAKRIPAERLWVNPDCGLKTRGWPETRAALANMVQAAQNLRRG

SEQ ID NO: 517 - protein, 1227 aa, Escherichia coli
MSSKVEQLRAQLNERILVLDGGMGTMIQSYRLNEADFRGERFADWPCDLKGNNDLLVLSKPEVIAAIHNAYFEAGADIIETNTFNSTTIAMADYQMESLSAEINFAAAKLARACADEWTARTPEKPRYVAGVLGPTNRTASISPDVNDPAFRNITFDGLVAAYRESTKALVEGGADLILIETVFDTLNAKAAVFAVKTEFEALGVELPIMISGTITDASGRTLSGQTTEAFYNSLRHAEALTFGLNCALGPDELRQYVQELSRIAECYVTAHPNAGLPNAFGEYDLDADTMAKQIREWAQAGFLNIVGGCCGTTPQHIAAMSRAVEGLAPRKLPEIPVACRLSGLEPLNIGEDSLFVNVGERTNVTGSAKFKRLIKEEKYSEALDVARQQVENGAQIIDINMDEGMLDAEAAMVRFLNLIAGEPDIARVPIMIDSSKWDVIEKGLKCIQGKGIVNSISMKEGVDAFIHHAKLLRRYGAAVVVMAFDEQGQADTRARKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPAELRDAVEDVILNRRDDGTERLLELAEKYRGSKTDDTANAQQAEWRSWEVNKRLEYSLVKGITEFIEQDTEEARQQATRPIEVIEGPLMDGMNVVGDLFGEGKMFLPQVVKSARVMKQAVAYLEPFIEASKEQGKTNGKMVIATVKGDVHDIGKNIVGVVLQCNNYEIVDLGVMVPAEKILRTAKEVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHGRKKPRTPPVTLEAARDNDFAFDWQAYTPPVAHRLGVQEVEASIETLRNYIDWTPFFMTWSLAGKYPRILEDEVVGVEAQRLFKDANDMLDKLSAEKTLNPRGVVGLFPANRVGDDIEIYRDETRTHVINVSHHLRQQTEKTGFANYCLADFVAPKLSGKADYIGAFAVTGGLEEDALADAFEAQHDDYNKIMVKALADRLAEAFAEYLHERVRKVYWGYAPNENLSNEELIRENYQGIRPAPGYPACPEHTEKATIWELLEVEKHTGMKLTESFAMWPGASVSGWYFSHPDSKYYAVAQIQRDQVEDYARRKGMSVTEVERWLAPNLGYDAD

SEQ ID NO: 518 - protein, 384 aa, Escherichia coli
MAKHLFTSESVSEGHPDKIADQISDAVLDAILEQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPITYAHRLVQRQAEVRKNGTLPWLRPDAKSQVTFQYDDGKIVGIDAVVLSTQHSEEIDQKSLQEAVMEEIIKPILPAEWLTSATKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYKETAAYGHFGREHFPWEKTDKAQLLRDAAGLK

SEQ ID NO: 519 - protein, 310 aa, Escherichia coli
MVKVYAPASSANMSVGFDVLGAAVTPVDGALLGDVVTVEAAETFSLNNLGRFADKLPSEPRENIVYQCWERFCQELGKQIPVAMTLEKNMPIGSGLGSSACSVVAALMAMNEHCGKPLNDTRLLALMGELEGRISGSIHYDNVAPCFLGGMQLMIEENDIISQQVPGFDEWLWVLAYPGIKVSTAEARAILPAQYRRQDCIAHGRHLAGFIHACYSRQPELAAKLMKDVIAEPYRERLLPGFRQARQAVAEIGAVASGISGSGPTLFALCDKPETAQRVADWLGKNYLQNQEGFVHICRLDTAGARVLEN

SEQ ID NO: 520 - protein, 428 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQETRNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 521 - protein, 514 aa, Escherichia coli [sequence omitted]

SEQ ID NO: 522 - protein, 410 aa, Escherichia coli
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 523 - protein, 362 aa, Escherichia coli
MAQIFNFSSGPAMLPAEVLKQAQQELRDWNGLGTSVMEVSHRGKEFIQVAEEAEKDFRDLLNVPSNYKVLFCHGGGRGQFAAVPLNILGDKTTADYVDAGYWAASAIKEAKKYCTPNVFDAKVTVDGLRAVKPMREWQLSDNAAYMHYCPNETIDGIAIDETPDFGADVVVAADFSSTILSRPIDVSRYGVIYAGAQKNIGPAGLTIVIVREDLLGKANIACPSILDYSILNDNGSMFNTPPTFAWYLSGLVFKWLKANGGVAEMDKINQQKAELLYGVIDNSDFYRNDVAKANRSRMNVPFQLADSALDKLFLEESFAAGLHALKGHRVVGGMRASIYNAMPLEGVKALTDFMVEFERRHG

SEQ ID NO: 524 - protein, 322 aa, Escherichia coli [sequence omitted]

SEQ ID NO: 525 - protein, 273 aa, Escherichia coli
MSCEELEIVWNNIKAEARTLADCEPMLASFYHATLLKHENLGSALSYMLANKLSSPIMPAIAIREVVEEAYAADPEMIASAACDIQAVRTRDPAVDKYSTPLLYLKGFHALQAYRIGHWLWNQGRRALAIFLQNQVSVTFQVDIHPAAKIGRGIMLDHATGIVVGETAVIENDVSILQSVTLGGTGKSGGDRHPKIREGVMIGAGAKILGNIEVGRGAKIGAGSVVLQPVPPHTTAAGVPARIVGKPDSDKPSMDMDQHFNGINHTFEYGDGI

SEQ ID NO: 526 - protein, 417 aa, Escherichia coli
MLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEAEAKELAGWMCDVLDSINDEAVIERIKGKVLDICARYPVYA

SEQ ID NO: 527 - protein, 398 aa, Escherichia coli
MRGEFYQQLTNDLETARAEGLFKEERIITSAQQADITVADGSHVINFCANNYLGLANHPDLIAAAKAGMDSHGFGMASVRFICGTQDSHKELEQKLAAFLGMEDAILYSSCFDANGGLFETLLGAEDAIISDALNHASIIDGVRLCKAKRYRYANNDMQELEARLKEAREAGARHVLIATDGVFSMDGVIANLKGVCDLADKYDALVMVDDSHAVGFVGENGRGSHEYCDVMGRVDIITGTLGKALGGASGGYTAARKEVVEWLRQRSRPYLFSNSLAPAIVAASIKVLEMVEAGSELRDRLWANARQFREQMSAAGFTLAGADHAIIPVMLGDAVVAQKFARELQKEGIYVTGFFYPVVPKGQARIRTQMSAAHTPEQITRAVEAFTRIGKQLGVIA

SEQ ID NO: 528 - protein, 341 aa, Escherichia coli
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 529 - protein, 87 aa, Escherichia coli
MMQHQVNVSARFNPETLERVLRVVRHRGFHVCSMNMAAASDAQNINIELTVASPRSVDLLFSQLNKLVDVAHVAICQSTTTSQQIRA

SEQ ID NO: 530 - protein, 193 aa, Escherichia coli
MLLKQLSDRKPADCVVTTDVGQHQMWAAQHIAHTRPENFITSSGLGTMGFGLPAAVGAQVARPNDTVVCISGDGSFMMNVQELGTVKRKQLPLKIVLLDNQRLGMVRQWQQLFFQERYSETTLTDNPDFLMLASAFGIHGQHITRKDQVEAALDTMLNSDGPYLLHVSIDELENVWPLVPPGASNSEMLEKLS

SEQ ID NO: 531 - protein, 327 aa, Escherichia coli
MNGAQWVVHALRAQGVNTVFGYPGGAIMPVYDALYDGGVEHLLCRHEQGAAMAAIGYARATGKTGVCIATSGPGATNLITGLADALLDSIPVVAITGQVSAPFIGTDAFQEVDVLGLSLACTKHSFLVQSLEELPRIMAEAFDVACSGRPGPVLVDIPKDIQLASGDLEPWFTTVENEVTFPHAEVEQARQMLAKAQKPMLYVGGGVGMAQAVPALREFLAATKMPATCTLKGLGAVEADYPYYLGMLGMHGTKAANFAVQECDLLIAVGARFDDRVTGKLNTFAPHASVIHMDIDPAEMNKLRQAHVALQGDLNALLPALQQPLNQ

SEQ ID NO: 532 - protein, 96 aa, Escherichia coli
MQNTTHDNVILELTVRNHPGVMTHVCGLFARRAFNVEGILCLPIQDSDKSHIWLLVNDDQRLEQMISQIDKLEDVVKVQRNQSDPTMFNKIAVFFQ

SEQ ID NO: 533 - protein, 562 aa, Escherichia coli
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPGPVWIDIPKDVQTAVFEIETQPAMAEKAAAPAFSEESIRDAAAMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPLVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYEQGVFAATYPGKINFMQIAAGFGLETCDLNNEADPQASLQEIINRPGPALIHVRIDAEEKVYPMVPPGAANTEMVGE

SEQ ID NO: 534 - protein, 163 aa, Escherichia coli
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLDAFLASIRDVAKIVEVARSGVVGLSRGDKIMR

SEQ ID NO: 535 - protein, 32 aa, Escherichia coli
MTALLRVISLVVISVVVIIIPPCGAALGRGKA

SEQ ID NO: 536 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 537 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 538 - protein, 309 aa, Escherichia coli
MTTKKADYIWFNGEMVRWEDAKVHVMSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDQVNQ

SEQ ID NO: 539 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 540 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 541 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 542 - protein, 1073 aa, Escherichia coli [sequence omitted]

SEQ ID NO: 543 - protein, 156 aa, Escherichia coli
MIQSQINRNIRLDLADAILLSKAKKDLSFAEIADGTGLAEAFVTAALLGQQALPADAARLVGAKLDLDEDSILLLQMIPLRGCIDDRIPTDPTMYRFYEMLQVYGTTLKALVHEKFGDGIISAINFKLDVKKVADPEGGERAVITLDGKYLPTKPF

SEQ ID NO: 544 - protein, 219 aa, Escherichia coli
MKEIIDGFLKFQREAFPKREALFKQLATQQSPRTLFISCSDSRLVPELVTQREPGDLFVIRNAGNIVPSYGPEPGGVSASVEYAVAALRVSDIVICGHSNCGAMTAIASCQCMDHMPAVSHWLRYADSARVVNEARPHSDLPSKAAAMVRENVIAQLANLQTHPSVRLALEEGRIALHGWVYDIESGSIAAFDGATRQFVPLAANPRVCAIPLRQPTAA

SEQ ID NO: 545 - protein, 443 aa, Escherichia coli
MVKERKTELVEGFRHSVPYINTHRGKTFVIMLGGEAIEHENFSSIVNDIGLLHSLGIRLVVVYGARPQIDANLAAHHHEPLYHKNIRVTDAKTLELVKQAAGTLQLDITARLSMSLNNTPLQGAHINVVSGNFIIAQPLGVDDGVDYCHSGRIRRIDEDAIHRQLDSGAIVLMGPVAVSVTGESFNLTSEEIATQLAIKLKAEKMIGFCSSQGVTNDDGDIVSELFPNEAQARVEAQEEKGDYNSGTVRFLRGAVKACRSGVRRCHLISYQEDGALLQELFSRDGIGTQIVMESAEQIRRATINDIGGILELIRPLEQQGILVRRSREQLEMEIDKFTIIQRDNTTIACAALYPFPEEKIGEMACVAVHPDYRSSSRGEVLLERIAAQAKQSGLSKLFVLTTRSIHWFQERGFTPVDIDLLPESKKQLYNYQRKSKVLMADLG

SEQ ID NO: 546 - protein, 258 aa, Escherichia coli
MMNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 547 - protein, 334 aa, Escherichia coli
MLNTLIVGASGYAGAELVTYVNRHPHMNITALTVSAQSNDAGKLISDLHPQLKGIVDLPLQPMSDISEFSPGVDVVFLATAHEVSHDLAPQFLEAGCVVFDLSGAFRVNDATFYEKYYGFTHQYPELLEQAAYGLAEWCGNKLKEANLIAVPGCYPTAAQLALKPLIDADLLDLNQWPVINATSGVSGAGRKAAISNSFCEVSLQPYGVFTHRHQPEIATHLGADVIFTPHLGNFPRGILETITCRLKSGVTQAQVAQVLQQAYAHKPLVRLYDKGVPALKNVVGLPFCDIGFAVQGEHLIIVATEDNLLKGAAAQAVQCANIRFGYAETQSLI

SEQ ID NO: 548 - protein, 406 aa, Escherichia coli
MSQPITRENFDEWMIPVYAPAPFIPVRGEGSRLWDQQGKEYIDFAGGIAVNALGHAHPELREALNEQASKFWHTGNGYTNEPVLRLAKKLIDATFADRVFFCNSGAEANEAALKLARKFAHDRYGSHKSGIVAFKNAFHGRTLFTVSAGGQPAYSQDFAPLPADIRHAAYNDINSASALIDDSTCAVIVEPIQGEGGVVPASNAFLQGLRELCNRHNALLIFDEVQTGVGRTGELYAYMHYGVTPDLLTTAKALGGGFPVGALLATEECARVMTVGTHGTTYGGNPLASAVAGKVLELINTPEMLNGVKQRHDWFVERLNTINHRYGLFSEVRGLGLLIGCVLNADYAGQAKQISQEAAKAGVMVLIAGGNVVRFAPALNVSEEEVTTGLDRFAAACEHFVSRGSS

SEQ ID NO: 549 - protein, 406 aa, Escherichia coli
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGRARDFLYAGAEAGVMVLNAGPDVMRFAPSLVVEDADIDEGMQRFAHAVAKVVGA

SEQ ID NO: 550 - protein, 383 aa, Escherichia coli
MKNKLPPFIEIYRALIATPSISATEEALDQSNADLITLLADWFKDLGFNVEVQPVPGTRNKFNMLASIGQGAGGLLLAGHTDTVPFDDGRWTRDPFTLTEHDGKLYGLGTADMKGFFAFILDALRDVDVTKLKKPLYILATADEETSMAGARYFAETTALRPDCAIIGEPTSLQPVRAHKGHISNAIRIQGQSGHSSDPARGVNAIELMHDAIGHILQLRDNLKERYHYEAFTVPYPTLNLGHIHGGDASNRICACCELHMDIRPLPGMTLNELNGLLNDALAPVSERWPGRLTVDELHPPIPGYECPPNHQLVEVVEKLLGAKTEVVNYCTEAPFIQTLCPTLVLGPGSINQAHQPDEYLETRFIKPTRELITQVIHHFCWH

SEQ ID NO: 551 - protein, 334 aa, Escherichia coli
MSDLYKKHFLKLLDFTPAQFTSLLTLAAQLKADKKNGKEVQKLTGKNIALIFEKDSTRTRCSFEVAAFDQGARVTYLGPSGSQIGHKESIKDTARVLGRMYDGIQYRGHGQEVVETLAQYAGVPVWNGLTNEFHPTQLLADLMTMQEHLPGKAFNEMTLVYAGDARNNMGNSMLEAAALTGLDLRLLAPKACWPEESLVAECSALAEKHGGKITLTEDVAAGVKGADFIYTDVWVSMGEAKEKWAERIALLRGYQVNAQMMALTDNPNVKFLHCLPAFHDDQTTLGKQMAKEFDLHGGMEVTDEVFESAASIVFDQAENRMHTIKAVMMATLGE

SEQ ID NO: 552 - protein, 334 aa, Escherichia coli
MSGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYASVPVWNGLTNEFHPTQLLADLLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKEKWAERIALLREYQVNSKMMQLTGNPEVKFLHCLPAFHDDQTTLGKKMAEEFGLHGGMEVTDEVFESAASIVFDQAENRMHTIKAVMVATLSK

SEQ ID NO: 553 - protein, 447 aa, Escherichia coli
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSAASGVPQVENLENKGQ

SEQ ID NO: 554 - protein, 457 aa, Escherichia coli
MALWGGRFTQAADQRFKQFNDSLRFDYRLAEQDIVGSVAWSKALVTVGVLTAEEQAQLEEALNVLLEDVRARPQQILESDAEDIHSWVEGKLIDKVGQLGKKLHTGRSRNDQVATDLKLWCKDTVSELLTANRQLQSALVETAQNNQDAVMPGYTHLQRAQPVTFAHWCLAYVEMLARDESRLQDALKRLDVSPLGCGALAGTAYEIDREQLAGWLGFASATRNSLDSVSDRDHVLELLSAAAIGMVHLSRFAEDLIFFNTGEAGFVELSDRVTSGSSLMPQKKNPDALELIRGKCGRVQGALTGMMMTLKGLPLAYNKDMQEDKEGLFDALDTWLDCLHMAALVLDGIQVKRPRCQEAAQQGYANATELADYLVAKGVPFREAHHIVGEAVVEAIRQGKPLEDLPLSELQKFSQVIDEDVYPILSLQSCLDKRAAKGGVSPQQVAQAIAFAQARLG

SEQ ID NO: 555 - protein, 658 aa, Escherichia coli
MSDDMSMGLPSSAGEHGVLRSMQEVAMSSQEASKMLRTYNIAWWGNNYYDVNELGHISVCPDPDVPEARVDLAQLVKTREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALIGEKMGHKVYLVIEKMSEIAIVLDEAERLNVVPRLGVRARLASQGSGKWQSSGGEKSKFGLAATQVLQLVETLREAGRLDSLQLLHFHLGSQMANIRDIATGVRESARFYVELHKLGVNIQCFDVGGGLGVDYEGTRSQSDCSVNYGLNEYANNIIWAIGDACEENGLPHPTVITESGRAVTAHHTVLVSNIIGVERNEYTVPTAPAEDAPRALQSMWETWQEMHEPGTRRSLREWLHDSQMDLHDIHIGYSSGIFSLQERAWAEQLYLSMCHEVQKQLDPQNRAHRPIIDELQERMADKMYVNFSLFQSMPDAWGIDQLFPVLPLEGLDQVPERRAVLLDITCDSDGAIDHYIDGDGIATTMPMPEYDPENPPMLGFFMVGAYQEILGNMHNLFGDTEAVDVFVFPDGSVEVELSDEGDTVADMLQYVQLDPKTLLTQFRDQVKKTDLDAELQQQFLEEFEAGLYGYTYLEDE

SEQ ID NO: 556 - protein, 755 aa, Escherichia coli
MKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 557 - protein, 306 aa, Escherichia coli
MSTLGHQYDNSLVSNAFGFLRLPMNFQPYDSDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPKEGLIDPNHSVQIGIRTEFDKDNGFTVLDACQVNDRSVDDVIAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 558 - protein, 459 aa, Escherichia coli
MNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 559 - protein, 711 aa, Escherichia coli
MKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPYRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVEIGIEARKAILARCKLFRPFIPPVVDGKLWQDYPTSVLASDRRFFSFEPGAKWHGFEGYAADQYFVDPCKLLLTTPGIDAETGEYSDFGVPATILAHYLRENGIVPEKCDLNSILFLLTPAESHEKLAQLVAMLAQFEQHIEDDSPLVEVLPSVYNKYPVRYRDYTLRQLCQEMHDLYVSFDVKDLQKAMFRQQSFPSVVMNPQDAHSAYIRGDVELVRIRDAEGRIAAEGALPYPPGVLCVVPGEVWGGAVQRYFLALEEGVNLLPGFSPELQGVYSETDADGVKRLYGYVLK

SEQ ID NO: 560 - protein, 732 aa, Escherichia coli
MSKLKIAVSDSCPDCFTTQRECIYINESRNIDVAAIVLSLNDVTCGKLDEIDATGYGIPVFIATENQERVPAEYLPRISGVFENCESRREFYGRQLETAASHYETQLRPPFFRALVDYVNQGNSAFDCPGHQGGEFFRRHPAGNQFVEYFGEALFRADLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELIAEVAPQRAKEARPFRLAVIQLGTYDGTIYNARQVVDKIGHLCDYILFDSAWVGYEQFIPMMADCSPLLLDLNENDPGILVTQSVHKQQAGFSQTSQIHKKDSHIKGQQRYVPHKRMNNAFMMHASTSPFYPLFAALNINAKMHEGVSGRNMWMDCVVNGINARKLILDNCQHIRPFVPELVDGKPWQSYETAQIAVDLRFFQFVPGEHWHSFEGYAENQYFVDPCKLLLTTPGIDARNGEYEAFGVPATILANFLRENGVVPEKCDLNSILFLLTPAEDMAKLQQLVALLVRFEKLLESDAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 561 - protein, 421 aa, Escherichia coli
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAVEFNDPQTGEPSAAIAQKIQQRALAQGLLLLTCGAYGNVIRFLYPLTIPDAQFDAAMKILQDALSD

SEQ ID NO: 562 - protein, 426 aa, Escherichia coli
MNSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYASSPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFDEAKQ

SEQ ID NO: 563 - protein, 474 aa, Escherichia coli
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 564 - protein, 288 aa, Escherichia coli
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAIHTAAFALPQYLQDALASQPS

SEQ ID NO: 565 - protein, 264 aa, Escherichia coli
MKKLKLHGFNNLTKSLSFCIYDICYAKTAEERDGYIAYIDELYNANRLTEILSETCSIIGANILNIARQDYEPQGASVTILVSEEPVDPKLIDKTEHPGPLPETVVAHLDKSHICVHTYPESHPEGGLCTFRADIEVSTCGVISPLKALNYLIHQLESDIVTIDYRVRGFTRDINGMKHFIDHEINSIQNFMSDDMKALYDMVDVNVYQENIFHTKMLLKEFDLKHYMFHTKPEDLTDSERQEITAALWKEMREIYYGRNMPAV

SEQ ID NO: 566 - protein, 273 aa, Escherichia coli
MHDANIRVAIAGAGGRMGRQLIQAALALEGVQLGAALEREGSSLLGSDAGELAGAGKTGVTVQSSLDAVKDDFDVFIDFTRPEGTLNHLAFCRQHGKGMVIGTTGFDEAGKQAIRDAAADIAIVFAANFSVGVNVMLKLLEKAAKVMGDYTDIEIIEAHHRHKVDAPSGTALAMGEAIAHALDKDLKDCAVYSREGHTGERVPGTIGFATVRAGDIVGEHTAMFADIGERLEITHKASSRMTFANGAVRSALWLSGKESGLFDMRDVLDLNNL

SEQ ID NO: 567 - protein, 274 aa, Escherichia coli
MQQLQNIIETAFERRAEITPANADTVTREAVNQVIALLDSGALRVAEKIDGQWVTHQWLKKAVLLSFRINDNQVIEGAESRYFDKVPMKFADYDEARFQKEGFRVVPPAAVRQGAFIARNTVLMPSYVNIGAYVDEGTMVDTWATVGSCAQIGKNVHLSGGVGIGGVLEPLQANPTIIEDNCFIGARSEVVEGVIVEEGSVISMGVYIGQSTRIYDRETGEIHYGRVPAGSVVVSGNLPSKDGKYSLYCAVIVKKVDAKTRGKVGINELLRTID

SEQ ID NO: 568 - protein, 375 aa, Escherichia coli
MSCPVIELTQQLIRRPSLSPDDAGCQALLIERLQAIGFTVERMDFADTQNFWAWRGQGETLAFAGHTDVVPPGDADRWINPPFEPTIRDGMLFGRGAADMKGSLAAMVVAAERFVAQHPNHTGRLAFLITSDEEASAHNGTVKVVEALMARNERLDYCLVGEPSSIEVVGDVVKNGRRGSLTCNLTIHGVQGHVAYPHLADNPVHRAAPFLNELVAIEWDQGNEFFPATSMQIANIQAGTGSNNVIPGELFVQFNFRFSTELTDEMIKAQVLALLEKHQLRYTVDWWLSGQPFLTARGKLVDAVVNAVEHYNEIKPQLLTTGGTSDGRFIARMGAQVVELGPVNATIHKINECVNAADLQLLARMYQRIMEQLVA

SEQ ID NO: 569 - protein, 274 aa, Escherichia coli
MQFSKMHGLGNDFMVVDAVTQNVFFSPELIRRLADRHLGVGFDQLLVVEPPYDPELDFHYRIFNADGSEVAQCGNGARCFARFVRLKGLTNKRDIRVSTANGRMVLTVTDDDLVRVNMGEPNFEPSAVPFRANKAEKTYIMRAAEQTILCGVVSMGNPHCVIQVDDVDTAAVETLGPVLESHERFPERANIGFMQVVKREHIRLRVYERGAGETQACGSGACAAVAVGIQQGLLAEEVRVELPGGRLDIAWKGPGHPLYMTGPAVHVYDGFIHL

SEQ ID NO: 570 - protein, 420 aa, Escherichia coli
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 571 - protein, 715 aa, Escherichia coli
MNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAAEDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 572 - protein, 713 aa, Escherichia coli
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTDEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRREFTRDSIEEKVAATTQAQWPVHAVITNSTYDGLLYNTDWIKQTLDVPSIHFDSAWVPYTHFHPIYQGKSGMSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFNDADADHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTKESRTVLDFLLMLCSVGQHYPGFETDIHGAKQDEDGVYRVRVLKMAG

SEQ ID NO: 573 - protein, 315 aa, Escherichia coli
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 574 - protein, 505 aa, Escherichia coli
MCGIVGIAGVMPVNQSIYDALTVLQHRGQDAAGIITIDANNCFRLRKANGLVSDVFEARHMQRLQGNMGIGHVRYPTAGSSSASEAQPFYVNSPYGITLAHNGNLTNAHELRKKLFEEKRRHINTTSDSEILLNIFASELDNFRHYPLEADNIFAAIAATNRLIRGAYACVAMIIGHGMVAFRDPNGIRPLVLGKRDIDENRTEYMVASESVALDTLGFDFLRDVAPGEAIYITEEGQLFTRQCADNPVSNPCLFEYVYFARPDSFIDKISVYSARVNMGTKLGEKIAREWEDLDIDVVIPIPETSCDIALEIARILGKPYRQGFVKNRYVGRTFIMPGQQLRRKSVRRKLNANRAEFRDKNVLLVDDSIVRGTTSEQIIEMAREAGAKKVYLASAAPEIRFPNVYGIDMPSATELIAHGREVDEIRQIIGADGLIFQDLNDLIDAVRAENPDIQQFECSVFNGVYVTKDVDQGYLDFLDTLRNDDAKAVQRQNEVENLEMHNEG

SEQ ID NO: 575 - protein, 429 aa, Escherichia coli
MKVLVIGNGGREHALAWKAAQSPLVETVFVAPGNAGTALEPALQNVAIGVTDIPALLDFAQNEKIDLTIVGPEAPLVKGVVDTFRAAGLKIFGPTAGAAQLEGSKAFTKDFLARHKIPTAEYQNFTEVEPALAYLREKGAPIVIKADGLAAGKGVIVAMTLEEAEAAVHDMLAGNAFGDAGHRIVIEEFLDGEEASFIVMVDGEHVLPMATSQDHKRVGDKDTGPNTGGMGAYSPAPVVTDDVHQRTMERIIWPTVKGMAAEGNTYTGFLYAGLMIDKQGNPKVIEFNCRFGDPETQPIMLRMKSDLVELCLAACESKLDEKTSEWDERASLGVVMAAGGYPGDYRTGDVIHGLPLEEVAGGKVFHAGTKLADDEQVVTNGGRVLCVTALGHTVAEAQKRAYALMTDIHWDDCFCRKDIGWRAIEREQN

SEQ ID NO: 576 - protein, 392 aa, Escherichia coli
MTLLGTALRPAATRVMLLGSGELGKEVAIECQRLGVEVIAVDRYADAPAMHVAHRSHVINMLDGDALRRVVELEKPHYIVPEIEAIATDMLIQLEEEGLNVVPCARATKLTMNREGIRRLAAEELQLPTSTYRFADSESLFREAVADIGYPCIVKPVMSSSGKGQTFIRSAEQLAQAWKYAQQGGRAGAGRVIVEGVVKFDFEITLLTVSAVDGVHFCAPVGHRQEDGDYRESWQPQQMSPLALERAQEIARKVVLALGGYGLFGVELFVCGDEVIFSEVSPRPHDTGMVTLISQDLSEFALHVRAFLGLPVGGIRQYGPAASAVILPQLTSQNVTFDNVQNAVGADLQIRLFGKPEIDGSRRLGVALATAESVVDAIERAKHAAGQVKVQG

SEQ ID NO: 577 - protein, 1295 aa, Escherichia coli
MMEILRGSPALSAFRINKLLARFQAARLPVHNIYAEYVHFADLNAPLNDDEHAQLERLLKYGPALASHAPQGKLLLVTPRPGTISPWSSKATDIAHNCGLQQVNRLERGVAYYIEAGTLTNEQWQQVTAELHDRMMETVFFALDDAEQLFAHHQPTPVTSVDLLGQGRQALIDANLRLGLALAEDEIDYLQDAFTKLGRNPNDIELYMFAQANSEHCRHKIFNADWVIDGEQQPKSLFKMIKNTFETTPDHVLSAYKDNAAVMEGSEVGRYFADHETGRYDFHQEPAHILMKVETHNHPTAISPWPGAATGSGGEIRDEGATGRGAKPKAGLVGFSVSNLRIPGFEQPWEEDFGKPERIVTALDIMTEGPLGGAAFNNEFGRPALNGYFRTYEEKVNSHNGEELRGYHKPIMLAGGIGNIRADHVQKGEINVGAKLVVLGGPAMNIGLGGGAASSMASGQSDADLDFASVQRDNPEMERRCQEVIDRCWQLGDANPILFIHDVGAGGLSNAMPELVSDGGRGGKFELREILSDEPGMSPLEIWCNESQERYVLAVAADQLPLFDELCKRERAPYAVIGEATEELHLSLHDRHFDNQPIDLPLDVLLGKTPKMTRDVQTLKAKGDALAREGITIADAVKRVLHLPTVAEKTFLVTIGDRSVTGMVARDQMVGPWQVPVANCAVTTASLDSYYGEAMAIGERAPVALLDFAASARLAVGEALTNIAATQIGDIKRIKLSANWMAAAGHPGEDAGLYEAVKAVGEELCPALGLTIPVGKDSMSMKTRWQEGNEEREMTSPLSLVISAFARVEDVRHTITPQLSTEDNALLLIDLGKGNNALGATALAQVYRQLGDKPADVRDVAQLKGFYDAIQALVAQRKLLAYHDRSDGGLLVTLAEMAFAGHCGIDADIATLGDDRLAALFNEELGAVIQVRAADREAVESVLAQHGLADCVHYVGQAVSGDRFVITANGQTVFSESRTTLRVWWAETTWQMQRLRDNPECADQEHQAKSNDADPGLNVKLSFDINEDVAAPYIATGARPKVAVLREQGVNSHVEMAAAFHRAGFDAIDVHMSDLLTGRTGLEDFHALVACGGFSYGDVLGAGEGWAKSILFNDRVRDEFATFFHRPQTLALGVCNGCQMMSNLRELIPGSELWPRFVRNTSDRFEARFSLVEVTQSPSLLLQGMVGSQMPIAVSHGEGRVEVRDAAHLAALESKGLVALRYVDNFGKVTETYPANPNGSPNGITAVTTESGRVTIMMPHPERVFRTVSNSWHPENWGEDGPWMRIFRNARKQLG

SEQ ID NO: 578 - protein, 345 aa, Escherichia coli
MTDKTSLSYKDAGVDIDAGNALVGRIKGVVKKTRRPEVMGGLGGFGALCALPQKYREPVLVSGTDGVGTKLRLAMDLKRHDTIGIDLVAMCVNDLVVQGAEPLFFLDYYATGKLDVDTASAVISGIAEGCLQSGCSLVGGETAEMPGMYHGEDYDVAGFCVGVVEKSEIIDGSKVSDGDVLIALGSSGPHSNGYSLVRKILEVSGCDPQTTELDGKPLADHLLAPTRIYVKSVLELIEKVDVHAIAHLTGGGFWENIPRVLPDNTQAVIDESSWQWPEVFNWLQTAGNVEHHEMYRTFNCGVGMIIALPAPEVDKALALLNANGENAWKIGIIKASDSEQRVVIE

SEQ ID NO: 579 - protein, 355 aa, Escherichia coli
MKQVCVLGNGQLGRMLRQAGEPLGIAVWPVGLDAEPAAVPFQQSVITAEIERWPETALTRELARHPAFVNRDVFPIIADRLTQKQLFDKLHLPTAPWQLLAERSEWPAVFDRLGELAIVKRRTGGYDGRGQWRLRANETEQLPAECYGECIVEQGINFSGEVSLVGARGFDGSTVFYPLTHNLHQDGILRTSVAFPQANAQQQAQAEEMLSAIMQELGYVGVMAMECFVTPQGLLINELAPRVHNSGHWTQNGASISQFELHLRAITDLPLPQPVVNNPSVMINLIGSDVNYDWLKLPLVHLHWYDKEVRPGRKVGHLNLTDSDTSRLTATLEALIPLLPPEYASGVIWAQSKFG

SEQ ID NO: 580 - protein, 169 aa, Escherichia coli
MSSRNNPARVAIVMGSKSDWATMQFAAEIFEILNVPHHVEVVSAHRTPDKLFSFAESAEENGYQVIIAGAGGAAHLPGMIAAKTLVPVLGVPVQSAALSGVDSLYSIVQMPRGIPVGTLAIGKAGAANAALLAAQILATHDKELHQRLNDWRKAQTDEVLENPDPRGAA

SEQ ID NO: 581 - protein, 237 aa, Escherichia coli [sequence omitted]

SEQ ID NO: 582 - protein, 456 aa, Escherichia coli
MELSSLTAVSPVDGRYGDKVSALRGIFSEYGLLKFRVQVEVRWLQKLAAHAAIKEVPAFAADAIGYLDAIVASFSEEDAARIKTIERTTNHDVKAVEYFLKEKVAEIPELHAVSEFIHFACTSEDINNLSHALMLKTARDEVILPYWRQLIDGIKDLAVQYRDIPLLSRTHGQPATPSTIGKEMANVAYRMERQYRQLNQVEILGKINGAVGNYNAHIAAYPEVDWHQFSEEFVTSLGIQWNPYTTQIEPHDYIAELFDCVARFNTILIDFDRDVWGYIALNHFKQKTIAGEIGSSTMPHKVNPIDFENSEGNLGLSNAVLQHLASKLPVSRWQRDLTDSTVLRNLGVGIGYALIAYQSTLKGVSKLEVNRDHLLDELDHNWEVLAEPIQTVMRRYGIEKPYEKLKELTRGKRVDAEGMKQFIDGLALPEEEKARLKAMTPANYIGRAITMVDELK

SEQ ID NO: 583 - protein, 529 aa, Escherichia coli
MQQRRPVRRALLSVSDKAGIVEFAQALSARGVELLSTGGTARLLAEKGLPVTEVSDYTGFPEMMDGRVKTLHPKVHGGILGRRGQDDAIMEEHQIQPIDMVVVNLYPFAQTVAREGCSLEDAVENIDIGGPTMVRSAAKNHKDVAIVVKSSDYDAIIKEMDDNEGSLTLATRFDLAIKAFEHTAAYDSMIANYFGSMVPAYHGESKEAAGRFPRTLNLNFIKKLDMRYGENSHQQAAFYIEENVKEASVATATQVQGKALSYNNIADTDAALECVKEFAEPACVIVKHANPCGVAIGNSILDAYDRAYKTDPTSAFGGIIAFNRELDAETAQAIISRQFVEVIIAPSASEEALKITAAKQNVRVLTCGQWGERVPGLDFKRVNGGLLVQDRDLGMVGAEELRVVTKRQPSEQELRDALFCWKVAKFVKSNAIVYAKNNMTIGIGAGQMSRVYSAKIAGIKAADEGLEVKGSSMASDAFFPFRDGIDAAAAAGVTCVIQPGGSIRDDEVIAAADEHGIAMLFTDMRHFRH

SEQ ID NO: 584 - protein, 488 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 585 - protein, 525 aa, Escherichia coli
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEASNEREFGYAQVEVVNDSALVRGIEDALTADGKPLLDVWMSHGDKVTAIPSDFITVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 586 - protein, 207 aa, Escherichia coli
MAQGTLYIVSAPSGAGKSSLIQALLKTQPLYDTQVSVSHTTRQPRPGEVHGEHYFFVNHDEFKEMISRDAFLEHAEVFGNYYGTSREAIEQVLATGVDVFLDIDWQGAQQIRQKMPHARSIFILPPSKIELDRRLRGRGQDSEEVIAKRMAQAVAEMSHYAEYDYLIVNDDFDTALTDLKTIIRAERLRMSRQKQRHDALISKLLAD

SEQ ID NO: 587 - protein, 143 aa, Escherichia coli
MAIERTFSIIKPNAVAKNVIGNIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 588 - protein, 761 aa, Escherichia coli
MNQNLLVTKRDGSTERINLDKIHRVLDWAAEGLHNVSISQVELRSHIQFYDGIKTSDIHETIIKAAADLISRDAPDYQYLAARLAIFHLRKKAYGQFEPPALYDHVVKMVEMGKYDNHLLEDYTEEEFKQMDTFIDHDRDMTFSYAAVKQLEGKYLVQNRVTGEIYESAQFLYILVAACLFSNYPRETRLQYVKRFYDAVSTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGVEGNRVRHMDYGVQINKLMYTRLLKGEDITLFSPSDVPGLYDAFFADQEEFERLYTKYEKDDSIRKQRVKAVELFSLMMQERASTGRIYIQNVDHCNTHSPFDPAIAPVRQSNLCLEIALPTKPLNDVNDENGEIALCTLSAFNLGAINNLDELEELAILAVRALDALLDYQDYPIPAAKRGAMGRRTLGIGVINFAYYLAKHGKRYSDGSANNLTHKTFEAIQYYLLKASNELAKEQGACPWFNETTYAKGILPIDTYKKDLDTIANEPLHYDWEALRESIKTHGLRNSTLSALMPSETSSQISNATNGIEPPRGYVSIKASKDGILRQVVPDYEHLHDAYELLWEMPGNDGYLQLVGIMQKFIDQSISANTNYDPSRFPSGKVPMQQLLKDLLTAYKFGVKTLYYQNTRDGAEDAQDDLVPSIQDDGCESGACKI

SEQ ID NO: 589 - protein, 376 aa, Escherichia coli
MAYTTFSQTKNDQLKEPMFFGQPVNVARYDQQKYDIFEKLIEKQLSFFWRPEEVDVSRDRIDYQALPEHEKHIFISNLKYQTLLDSIQGRSPNVALLPLISIPELETWVETWAFSETIHSRSYTHIIRNIVNDPSVVFDDIVTNEQIQKRAEGISSYYDELIEMTSYWHLLGEGTHTVNGKTVTVSLRELKKKLYLCLMSVNALEAIRFYVSFACSFAFAERELMEGNAKIIRLIARDEALHLTGTQHMLNLLRSGADDPEMAEIAEECKQECYDLFVQAAQQEKDWADYLFRDGSMIGLNKDILCQYVEYITNIRMQAVGLDLPFQTRSNPIPWINTWLVSDNVQVAPQEVEVSSYLVGQIDSEVDTDDLSNFQL

SEQ ID NO: 590 - protein, 712 aa, Escherichia coli
MTPHVMKRDGCKVPFKSERIKEAILRAAKAAEVDDADYCATVAAVVSEQMQGRNQVDINEIQTAVENQLMSGPYKQLARAYIEYRHDRDIEREKRGRLNQEIRGLVEQTNASLLNENANKDSKVIPTQRDLLAGIVAKHYARQHLLPRDVVQAHERGDIHYHDLDYSPFFPMFNCMLIDLKGMLTQGFKMGNAEIEPPKSISTATAVTAQIIAQVASHIYGGTTINRIDEVLAPFVTASYNKHRKTAEEWNIPDAEGYANSRTIKECYDAFQSLEYEVNTLHTANGQTPFVTFGFGLGTSWESRLIQESILRNRIAGLGKNRKTAVFPKLVFAIRDGLNHKKGDPNYDIKQLALECASKRMYPDILNYDQVVKVTGSFKTPMGCRSFLGVWENENGEQIHDGRNNLGVISLNLPRIALEAKGDEATFWKLLDERLVLARKALMTRIARLEGVKARVAPILYMEGACGVRLNADDDVSEIFKNGRASISLGYIGIHETINALFGGEHVYDNEQLRAKGIAIVERLRQAVDQWKEETGYGFSLYSTPSENLCDRFCRLDTAEFGVVPGVTDKGYYTNSFHLDVEKKVNPYDKIDFEAPYPPLANGGFICYGEYPNIQHNLKALEDVWDYSYQHVPYYGTNTPIDECYECGFTGEFECTSKGFTCPKCGNHDASRVSVTRRVCGYLGSPDARPFNAGKQEEVKRRVKHLGNGQIG

SEQ ID NO: 591 - protein, 214 aa, Escherichia coli
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRADLEKILG

SEQ ID NO: 592 - protein, 319 aa, Escherichia coli
MKLSRISAINWNKISDDKDLEVWNRLTSNFWLPEKVPLSNDIPAWQTLTVVEQQLTMRVFTGLTLLDTLQNVIGAPSLMPDALTPHEEAVLSNISFMEAVHARSYSSIFSTLCQTKDVDAAYAWSEENAPLQRKAQIIQQHYRGDDPLKKKIASVFLESFLFYSGFWLPMYFSSRGKLTNTADLIRLIIRDEAVHGYYIGYKYQKNMEKISLGQREELKSFAFDLLLELYDNELQYTDELYAETPWADDVKAFLCYNANKALMNLGYEPLFPAEMAEVNPAILAALSPNADENHDFFSGSGSSYVMGKAVETEDEDWNF

SEQ ID NO: 593 - protein, 714 aa, Escherichia coli
MATTTAECLTQETMDYHALNAMLNLYDSAGRIQFDKDRQAVDAFIATHVRPNSVTFSSQQQRLNWLVNEGYYDESVLNRYSRDFVITLFTHAHTSGFRFQTFLGAWKFYTSYTLKTFDGKRYLEDFADRVTMVALTLAQGDETLALQLTDEMLSGRFQPATPTFLNCGKQQRGELVSCFLLRIEDNMESIGRAVNSALQLSKRGGGVAFLLSNLREAGAPIKRIENQSSGVIPVMKMLEDAFSYANQLGARQGAGAVYLHAHHPDILRFLDTKRENADEKIRIKTLSLGVVIPDITFHLAKENAQMALFSPYDVERVYGKPFADVAISQHYDELVADERIRKKYLNARDFFQRLAEIQFESGYPYIMYEDTVNRANPIAGRINMSNLCSEILQVNSASEYDENLDYTRTGHDISCNLGSLNIAHTMDSPDFARTVETAVRGLTAVSDMSHIRSVPSIEAGNAASHAIGLGQMNLHGYLAREGIAYGSPEALDFTNLYFYAITWHALRTSMLLARERGETFAGFKQSRYASGEYFSQYLQGNWQPKTAKVGELFTRSGITLPTREMWAQLRDDVMRYGIYNQNLQAVPPTGSISYINHATSSIHPIVAKVEIRKEGKTGRVYYPAPFMTNENLALYQDAYEIGAEKIIDTYAEATRHVDQGLSLTLFFPDTATTRDINKAQIYAWRKGIKTLYYIRLRQMALEGTEIEGCVSCAL

SEQ ID NO: 594 - protein, 432 aa, Escherichia coli
MGNNVVVLGTQWGDEGKGKIVDLLTERAKYVVRYQGGHNAGHTLVINGEKTVLHLIPSGILRENVTSIIGNGVVLSPAALMKEMKELEDRGIPVRERLLLSEACPLILDYHVALDNAREKARGAKAIGTTGRGIGPAYEDKVARRGLRVGDLFDKETFAEKLKEVMEYHNFQLVNYYKAEAVDYQKVLDDTMAVADILTSMVVDVSDLLDQARQRGDFVMFEGAQGTLLDIDHGTYPYVTSSNTTAGGVATGSGLGPRYVDYVLGILKAYSTRVGAGPFPTELFDETGEFLCKQGNEFGATTGRRRRTGWLDTVAVRRAVQLNSLSGFCLTKLDVLDGLKEVKLCVAYRMPDGREVTTTPLAADDWKGVEPIYETMPGWSESTFGVKDRSGLPQAALNYIKRIEELTGVPIDIISTGPDRTETMILRDPFDA

SEQ ID NO: 595 - protein, 153 aa, Escherichia coli
MTHDNKLQVEAIKRGTVIDHIPAQIGFKLLSLFKLTETDQRITIGLNLPSGEMGRKDLIKIENTFLSEDQVDQLALYAPQATVNRIDNYEVVGKSRPSLPERIDNVLVCPNSNCISHAEPVSSSFAVRKRANDIALKCKYCEKEFSHNVVLAN

SEQ ID NO: 596 - protein, 311 aa, Escherichia coli; identical to SEQ ID NO: 504

SEQ ID NO: 597 - protein, 348 aa, Escherichia coli [sequence omitted]

SEQ ID NO: 598 - protein, 336 aa, Escherichia coli
MYYPFVRKALFQLDPERAHEFTFQQLRRITGTPFEALVRQKVPAKPVNCMGLTFKNPLGLAAGLDKDGECIDALGAMGFGSIEIGTVTPRPQPGNDKPRLFRLVDAEGLINRMGFNNLGVDNLVENVKKAHYDGVLGINIGKNKDTPVEQGKDDYLICMEKIYAYAGYIAINISSPNTPGLRTLQYGEALDDLLTAIKNKQNDLQAMHHKYVPIAVKIAPDLSEEELIQVADSLVRHNIDGVIATNTTLDRSLVQGMKNCDQTGGLSGRPLQLKSTEIIRRLSLELNGRLPIIGVGGIDSVIAAREKIAAGASLVQIYSGFIFKGPPLIKEIVTHI

SEQ ID NO: 599 - protein, 213 aa, Escherichia coli
MKPYQRQFIEFALSKQVLKFGEFTLKSGRKSPYFFNAGLFNTGRDLALLGRFYAEALVDSGIEFDLLFGPAYKGIPIATTTAVALAEHHDLDLPYCFNRKEAKDHGEGGNLVGSALQGRVMLVDDVITAGTAIRESMEIIQANGATLAGVLISLDRQERGRGEISAIQEVERDYNCKVISIITLKDLIAYLEEKPEMAEHLAAVKAYREEFGV

SEQ ID NO: 600 - protein, 245 aa, Escherichia coli
MTLTASSSSRAVTNSPVVVALDYHNRDDALAFVDKIDPRDCRLKVGKEMFTLFGPQFVRELQQRGFDIFLDLKFHDIPNTAAHAVAAAADLGVWMVNVHASGGARMMTAAREALVPFGKDAPLLIAVTVLTSMEASDLVDLGMTLSPADYAERLAALTQKCGLDGVVCSAQEAVRFKQVFGQEFKLVTPGIRPQGSEAGDQRRIMTPEQALSAGVDYMVIGRPVTQSVDPAQTLKAINASLQRSA

SEQ ID NO: 601 - protein, 241 aa, Escherichia coli
MATNAKPVYKRILLKLSGEALQGTEGFGIDASILDRMAQEIKELVELGIQVGVVIGGGNLFRGAGLAKAGMNRVVGDHMGMLATVMNGLAMRDALHRAYVNARLMSAIPLNGVCDSYSWAEAISLLRNNRVVILSAGTGNPFFTTDSAACLRGIEIEADVVLKATKVDGVFTADPAKDPTATMYEQLTYSEVLEKELKVMDLAAFTLARDHKLPIRVFNMNKPGALRRVVMGEKEGTLITE

SEQ ID NO: 602 - protein, 545 aa, Escherichia coli
MTTNYIFVTGGVVSSLGKGIAAASLAAILEARGLNVTIMKLDPYINVDPGTMSPIQHGEVFVTEDGAETDLDLGHYERFIRTKMSRRNNFTTGRIYSDVLRKERRGDYLGATVQVIPHITNAIKERVLEGGEGHDVVLVEIGGTVGDIESLPFLEAIRQMAVEIGREHTLFMHLTLVPYMAASGEVKTKPTQHSVKELLSIGIQPDILICRSDRAVPANERAKIALFCNVPEKAVISLKDVDSIYKIPGLLKSQGLDDYICKRFSLNCPEANLSEWEQVIFEEANPVSEVTIGMVGKYIELPDAYKSVIEALKHGGLKNRVSVNIKLIDSQDVETRGVEILKGLDAILVPGGFGYRGVEGMITTARFARENNIPYLGICLGMQVALIDYARHVANMENANSTEFVPDCKYPVVALITEWRDENGNVEVRSEKSDLGGTMRLGAQQCQLVDDSLVRQLYNAPTIVERHRHRYEVNNMLLKQIEDAGLRVAGRSGDDQLVEIIEVPNHPWFVACQFHPEFTSTPRDGHPLFAGFVKAASEFQKRQAK

SEQ ID NO: 603 - protein, 459 aa, Escherichia coli; identical to SEQ ID NO: 558

SEQ ID NO: 604 - DNA, 1503 bp, Saccharomyces cerevisiae
atgtcattcgacgacttacacaaagccactgagagagcggtcatccaggccgtggaccagatctgcgacgatttcgaggttacccccgagaagctggacgaattaactgcttacttcatcgaacaaatggaaaaaggtctagctccaccaaaggaaggccacacattggcctcggacaaaggtcttcctatgattccggcgttcgtcaccgggtcacccaacgggacggagcgcggtgttttactagccgccgacctgggtggtaccaatttccgtatatgttctgttaacttgcatggagatcatactttctccatggagcaaatgaagtccaagattcccgatgatttgctagacgatgagaacgtcacatctgacgacctgtttgggtttctagcacgtcgtacactggcctttatgaagaagtatcacccggacgagttggccaagggtaaagacgccaagcccatgaaactggggttcactttctcataccctgtagaccagacctctctaaactccgggacattgatccgttggaccaagggtttccgcatcgcggacaccgtcggaaaggatgtcgtgcaattgtaccaggagcaattaagcgctcagggtatgcctatgatcaaggttgttgcattaaccaacgacaccgtcggaacgtacctatcgcattgctacacgtccgataacacggactcaatgacgtccggagaaatctcggagccggtcatcggatgtattttcggtaccggtaccaatgggtgctatatggaggagatcaacaagatcacgaagttgccacaggagttgcgtgacaagttgataaaggagggtaagacacacatgatcatcaatgtcgaatgggggtccttcgataatgagctcaagcacttgcctactactaagtatgacgtcgtaattgaccagaaactgtcaacgaacccgggatttcacttgtttgaaaaacgtgtctcagggatgttcttgggtgaggtgttgcgtaacattttagtggacttgcactcgcaaggcttgcttttgcaacagtacaggtccaaggaacaacttcctcgccacttgactacacctttccagttgtcatccgaagtgctgtcgcatattgaaattgacgactcgacaggtctacgtgaaacagagttgtcattattacagagtctcagactgcccaccactccaacagagcgtgttcaaattcaaaaattggtgcgcgcgatttctaggagatctgcgtatttagccgccgtgccgcttgccgcgatattgatcaagacaaatgctttgaacaagagatatcatggtgaagtcgagatcggttgtgatggttccgttgtggaatactaccccggtttcagatctatgctgagacacgccttagccttgtcacccttgggtgccgagggtgagaggaaggtgcacttgaagattgccaaggatggttccggagtgggtgccgccttgtgtgcgcttgtagcatga

SEQ ID NO: 605 - DNA, 1518 bp, Saccharomyces cerevisiae
atgagtgaaggccccgtcaaattcgaaaaaaataccgtcatatctgtctttggtgcgtcaggtgatctggcaaagaagaagacttttcccgccttatttgggcttttcagagaaggttaccttgatccatctaccaagatcttcggttatgcccggtccaaattgtccatggaggaggacctgaagtcccgtgtcctaccccacttgaaaaaacctcacggtgaagccgatgactctaaggtcgaacagttcttcaagatggtcagctacatttcgggaaattacgacacagatgaaggcttcgacgaattaagaacgcagatcgagaaattcgagaaaagtgccaacgtcgatgtcccacaccgtctcttctatctggccttgccgccaagcgtttttttgacggtggccaagcagatcaagagtcgtgtgtacgcagagaatggcatcacccgtgtaatcgtagagaaacctttcggccacgacctggcctctgccagggagctgcaaaaaaacctggggcccctctttaaagaagaagagttgtacagaattgaccattacttgggtaaagagttggtcaagaatcttttagtcttgaggttcggtaaccagtttttgaatgcctcgtggaatagagacaacattcaaagcgttcagatttcgtttaaagagaggttcggcaccgaaggccgtggcggctatttcgactctataggcataatcagagacgtgatgcagaaccatctgttacaaatcatgactctcttgactatggaaagaccggtgtcttttgacccggaatctattcgtgacgaaaaggttaaggttctaaaggccgtggcccccatcgacacggacgacgtcctcttgggccagtacggtaaatctgaggacgggtctaagcccgcctacgtggatgatgacactgtagacaaggactctaaatgtgtcacttttgcagcaatgactttcaacatcgaaaacgagcgttgggagggcgtccccatcatgatgcgtgccggtaaggctttgaatgagtccaaggtggagatcagactgcagtacaaagcggtcgcatcgggtgtcttcaaagacattccaaataacgaactggtcatcagagtgcagcccgatgccgctgtgtacctaaagtttaatgctaagacccctggtctgtcaaatgctacccaagtcacagatctgaatctaacttacgcaagcaggtaccaagacttttggattccagaggcttacgaggtgttgataagagacgccctactgggtgaccattccaactttgtcagagatgacgaattggatatcagttggggcatattcaccccattactgaagcacatagagcgtccggacggtccaacaccggaaatttacccctacggatcaagaggtccaaagggattgaaggaatatatgcaaaaacacaagtatgttatgcccgaaaagcacccttacgcttggcccgtgactaagccagaagatacgaaggataattag

SEQ ID NO: 606 - DNA, 750 bp, Saccharomyces cerevisiae
atggtgacagtcggtgtgttttctgagagggctagtttgacccatcaattgggggaattcatcgtcaagaaacaagatgaggcgctgcaaaagaagtcagactttaaagtttccgttagcggtggctctttgatcgatgctctgtatgaaagtttagtagcggacgaatcactatcttctcgagtgcaatggtctaaatggcaaatctacttctctgatgaaagaattgtgccactgacggacgctgacagcaattatggtgccttcaagagagctgttctagataaattaccctcgactagtcagccaaacgtttatcccatggacgagtccttgattggcagcgatgctgaatctaacaacaaaattgctgcagagtacgagcgtatcgtacctcaagtgcttgatttggtactgttgggctgtggtcctgatggacacacttgttccttattccctggagaaacacataggtacttgctgaacgaaacaaccaaaagagttgcttggtgccacgattctcccaagcctccaagtgacagaatcaccttcactctgcctgtgttgaaagacgccaaagccctgtgttttgtggctgagggcagttccaaacaaaatataatgcatgagatctttgacttgaaaaacgatcaattgccaaccgcattggttaacaaattatttggtgaaaaaacatcctggttcgttaatgaggaagcttttggaaaagttcaaacgaaaactttttag

SEQ ID NO: 607 - DNA, 768 bp, Saccharomyces cerevisiae
atggtgaaattacaaaggtttagcgaaaagaaaagcctcatacacgaattcggcaagtttatccttgaaaagcaagaatcggcgttaacgggcgacgctgatgcagtgttcaatatcgccatcagtggaggatcgatgaaccaagcgctgtacgaaagtttggtaaatgacaaaaacatttttccacatattaagtggccacaatggagaatcttcttctgtgacgaaagattggttccatttgaggatccgcaaagtaactatggtcagttcaaaaaaacagttttggacccgctagtgcatcagggcaaccaattgaacttaggccccactgtatacactatcaacgaatcattaatcggtggcggtgaaacggccaatagaaagattgccgaagaatacgcttccatgctgcctgcatcattcgacctaatcttactcggatgcggagaagatggacatacatgctcgttgtttcccggggttgaatttaattaccttgtagaagagatggaccgcaaggttttatggtgtaataattcgcccaaggcacccaaggacaggatcacctttacattagcagtagtagccgaggctaaaagtgtgtgctttctcgttaggggagctgctaaaaaggctatcatgcatgacgtgttaatcgtaaaaaatagcgaactacctagtgtgctggttaatgaaatggtcggaaccaaagtaacttggtttctcgacgacgaagctggcgccttgattcctgaaaactgctaa

SEQ ID NO: 608 - DNA, 1470 bp, Saccharomyces cerevisiae
atgtctgctgatttcggtttgattggtttggccgtcatgggtcaaaatttgatcttgaacgctgctgaccacggtttcactgtttgtgcttacaacagaactcaatccaaggtcgaccatttcttggccaatgaagctaagggcaaatctatcatcggtgctacttccattgaagatttcatctccaaattgaagagacctagaaaggtcatgcttttggttaaagctggtgctccagttgacgctttgatcaaccaaatcgtcccacttttggaaaagggtgatattatcatcgatggtggtaactctcacttcccagattctaatagacgttacgaagaattgaagaagaagggtattcttttcgttggttctggtgtctccggtggtgaggaaggtgcccgttacggtccatctttgatgccaggtggttctgaagaagcttggccacatattaagaacatcttccaatccatctctgctaaatccgacggtgaaccatgttgcgaatgggttggcccagccggtgctggtcactacgtcaagatggttcacaacggtattgaatacggtgatatgcaattgatttgtgaagcttatgacatcatgaagagattgggtgggtttaccgataaggaaatcagtgacgtttttgccaaatggaacaatggtgtcttggattccttcttggtcgaaattaccagagatattttgaaattcgacgacgtcgacggtaagccattagttgaaaaaatcatggatactgctggtcaaaagggtactggtaagtggactgccatcaacgccttggatttgggtatgccagttactttgattggtgaagctgtctttgcccgttgtctatctgctttgaagaacgagagaattagagcctccaaggtcttaccaggcccagaagttccaaaagacgccgtcaaggacagagaacaatttgtcgatgatttggaacaagctttgtatgcttccaagattatttcttacgctcaaggtttcatgttgatccgtgaagctgctgctacttatggctggaaactaaacaaccctgccatcgctttgatgtggagaggtggttgtatcattagatctgttttcttgggtcaaatcacaaaggcctacagagaagaaccagatttggaaaacttgttgttcaacaagttcttcgctgatgccgtcaccaaggctcaatctggttggagaaagtcaattgcgttggctaccacctacggtatcccaacaccagccttttccaccgctttgtctttctacgatgggtacagatctgaaagattgccagccaacttactacaagctcaacgtgactactttggtgctcacactttcagagtgttgccagaatgtgcttctgacaacttgccagtagacaaggatatccatatcaactggactggccacggtggtaatgtttcttcctctacataccaagcttaa

SEQ ID NO: 609 - DNA, 1479 bp, Saccharomyces cerevisiae
atgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaa

SEQ ID NO: 610 - DNA, 597 bp, Saccharomyces cerevisiae
atggatattattctgggcatccgtgtacaggattctgtcattctagcgtcttctaaggcagtcacaagaggtatttctgttttaaaagattctgatgataaaacgagacaattatcgccacatacattgatgagttttgccggtgaagctggtgacaccgttcaattcgccgagtacattcaagccaatatccaattatactccattagagaagattatgagctctctccacaagcagtatctagttttgttaggcaagaattagccaagtcaattaggtcgagaagaccataccaagtcaacgtattgattggaggctatgacaaaaagaagaacaaaccggaactatatcaaattgactacttgggtactaaagtcgaattaccctatggtgctcatggttactcggggttttacacattctctttactagatcatcattatagacctgatatgactactgaggagggtttagatttattaaaactatgtgtacaagagcttgaaaaaagaatgccaatggacttcaagggcgtcattgttaaaatcgtggataaagatggcataagacaagtagatgacttccaggcacagtga

SEQ ID NO: 611 - DNA, 1008 bp, Saccharomyces cerevisiae
atgtctgaaccagctcaaaagaaacaaaaggttgctaacaactctctagaacaattgaaagcctccggcactgtcgttgttgccgacactggtgatttcggctctattgccaagtttcaacctcaagactccacaactaacccatcattgatcttggctgctgccaagcaaccaacttacgccaagttgatcgatgttgccgtggaatacggtaagaagcatggtaagaccaccgaagaacaagtcgaaaatgctgtggacagattgttagtcgaattcggtaaggagatcttaaagattgttccaggcagagtctccaccgaagttgatgctagattgtcttttgacactcaagctaccattgaaaaggctagacatatcattaaattgtttgaacaagaaggtgtctccaaggaaagagtccttattaaaattgcttccacttgggaaggtattcaagctgccaaagaattggaagaaaaggacggtatccactgtaatttgactctattattctccttcgttcaagcagttgcctgtgccgaggcccaagttactttgatttccccatttgttggtagaattctagactggtacaaatccagcactggtaaagattacaagggtgaagccgacccaggtgttatttccgtcaagaaaatctacaactactacaagaagtacggttacaagactattgttatgggtgcttctttcagaagcactgacgaaatcaaaaacttggctggtgttgactatctaacaatttctccagctttattggacaagttgatgaacagtactgaacctttcccaagagttttggaccctgtctccgctaagaaggaagccggcgacaagatttcttacatcagcgacgaatctaaattcagattcgacttgaatgaagacgctatggccactgaaaaattgtccgaaggtatcagaaaattctctgccgatattgttactctattcgacttgattgaaaagaaagttaccgcttaa

SEQ ID NO: 612 - DNA, 2880 bp, Saccharomyces cerevisiae
atgactgttactactccttttgtgaatggtacttcttattgtaccgtcactgcatattccgttcaatcttataaagctgccatagatttttacaccaagtttttgtcattagaaaaccgctcttctccagatgaaaactccactttattgtctaacgattccatctctttgaagatccttctacgtcctgatgaaaaaatcaataaaaatgttgaggctcatttgaaggaattgaacagtattaccaagactcaagactggagatcacatgccacccaatccttggtatttaacacttccgacatcttggcagtcaaggacactctaaatgctatgaacgctcctcttcaaggctacccaacagaactatttccaatgcagttgtacactttggacccattaggtaacgttgttggtgttacttctactaagaacgcagtttcaaccaagccaactccaccaccagcaccagaagcttctgctgagtctggtctttcctctaaagttcactcttacactgatttggcttaccgtatgaaaaccaccgacacctatccatctctgccaaagccattgaacaggcctcaaaaggcaattgccgtcatgacttccggtggtgatgctccaggtatgaactctaacgttagagccatcgtgcgttccgctatcttcaaaggttgtcgtgcctttgttgtcatggaaggttatgaaggtttggttcgtggtggtccagaatacatcaaggaattccactgggaagacgtccgtggttggtctgctgaaggtggtaccaacattggtactgcccgttgtatggaattcaagaagcgcgaaggtagattattgggtgcccaacatttgattgaggccggtgtcgatgctttgatcgtttgtggtggtgacggttctttgactggtgctgatctgtttagatcagaatggccttctttgatcgaggaattgttgaaaacaaacagaatttccaacgaacaatacgaaagaatgaagcatttgaatatttgcggtactgtcggttctattgataacgatatgtccaccacggatgctactattggtgcttactctgccttggacagaatctgtaaggccatcgattacgttgaagccactgccaactctcactcaagagctttcgttgttgaagttatgggtagaaactgtggttggttagctttattagctggtatcgccacttccgctgactatatctttattccagagaagccagccacttccagcgaatggcaagatcaaatgtgtgacattgtctccaagcacagatcaaggggtaagagaaccaccattgttgttgttgcagaaggtgctatcgctgctgacttgaccccaatttctccaagcgacgtccacaaagttctagttgacagattaggtttggatacaagaattactaccttaggtcacgttcaaagaggtggtactgctgttgcttacgaccgtatcttggctactttacaaggtcttgaggccgttaatgccgttttggaatccactccagacaccccatcaccattgattgctgttaacgaaaacaaaattgttcgtaaaccattaatggaatccgtcaagttgaccaaagcagttgcagaagccattcaagctaaggatttcaagagagctatgtctttaagagacactgagttcattgaacatttaaacaatttcatggctatcaactctgctgaccacaacgaaccaaagctaccaaaggacaagagactgaagattgccattgttaatgtcggtgctccagctggtggtatcaactctgccgtctactcgatggctacttactgtatgtcccaaggtcacagaccatacgctatctacaatggttggtctggtttggcaagacatgaaagtgttcgttctttgaactggaaggatatgttgggttggcaatcccgtggtggttctgaaatcggtactaacagagtcactccagaagaagcagatctaggtatgattgcttactatttccaaaagtacgaatttgatggtttgatcatcgttggtggtttcgaagcttttgaatctttacatcaattagagagagcaagagaaagttatccagctttcagaatcccaatggtcttgataccagctactttgtctaacaatgttccaggtactgaatactctttgggttctgataccgctttgaatgctctaatggaatactgtgatgttgttaaacaatccgcttcttcaaccagaggtagagccttcgttgtcgattgtcaaggtggtaactcaggctatttggccacttacgcttctttggctgttggtgctcaagtctcttatgtcccagaagaaggtatttctttggagcaattgtccgaggatattgaatacttagctcaatcttttgaaaaggcagaaggtagaggtagatttggtaaattgattttgaagagtacaaacgcttctaaggctttatcagccactaaattggctgaagttattactgctgaagccgatggcagatttgacgctaagccagcttatccaggtcatgtacaacaaggtggtttgccatctccaattgatagaacaagagccactagaatggccattaaagctgtcggcttcatcaaagacaaccaagctgccattgctgaagctcgtgctgccgaagaaaacttcaacgctgatgacaagaccatttctgacactgctgctgtcgttggtgttaagggttcacatgtcgtttacaactccattagacaattgtatgactatgaaactgaagtttccatgagaatgccaaaggtcattcactggcaagctaccagactcattgctgaccatttggttggaagaaagagagttgattaa

SEQ ID NO: 613 - DNA, 2964 bp, Saccharomyces cerevisiae
atgcaatctcaagattcatgctacggtgttgcattcagatctatcatcacaaatgatgaagctttattcaagaagaccattcacttttatcacactctaggatttgcaactgtgaaagatttcaacaaattcaaacatggtgaaaatagcttactatcttcagggacttcccaagattccttgagagaagtttggttagaatctttcaagttgagtgaggttgatgcttctgggttccgtataccacaacaagaagctactaacaaggctcaaagtcaaggtgctctattaaagattcgtttagtgatgtctgctccaatcgatgaaactttcgacaccaacgaaaccgccacaatcacttatttctctactgatttgaacaagattgtcgagaaattcccaaaacaagccgaaaaattgtccgataccttagtgtttttgaaagatccaatgggcaacaacatcaccttctcaggcttagctaatgcaaccgattccgctccaacttccaaagatgctttcttagaagctacctccgaagacgaaatcatctctagagcttcttccgatgcttctgacttactaagacaaacattgggctcttctcaaaagaagaagaagattgctgtcatgacttctggtggtgattctccaggtatgaatgccgctgttcgtgccgttgttcgtacaggtatacatttcggctgtgatgtttttgctgtttacgaaggttacgaaggtttactaagaggcggtaaatatttaaagaaaatggcttgggaagatgtcagaggttggttaagtgaaggtggtactttgattggtactgctcgttctatggaattcagaaagcgtgagggtcgtagacaagctgcaggcaatttaatttcgcaaggtattgacgctttggttgtttgtggtggtgatggttctttaaccggtgctgatcttttcagacacgaatggccatctttggttgatgaattggttgcagaaggtagattcactaaagaagaagtcgccccatacaagaatttgtccattgttggtcttgtcggttccatcgataatgatatgtctggtactgactctaccattggtgcttattctgctttggaaagaatctgtgaaatggttgactacattgatgccaccgctaaatcccactcccgtgcctttgttgttgaagttatgggtagacattgtggttggttggccttgatggctggtattgctaccggtgccgattacatttttattccagaaagagctgttcctcacggaaaatggcaggacgaattgaaggaagtgtgccaaagacacagaagtaagggtagaagaaataacacaattattgtcgctgaaggtgctttagatgatcaattaaaccctgttactgccaatgacgtcaaagatgctttgattgaattgggtctagacaccaaggtaaccattctaggtcacgttcaaagaggtggtacagctgttgctcatgacagatggttagctactctacaaggtgtcgatgctgttaaggccgttctggaatttacccctgaaactccttctccattaattggtattttagaaaacaagataattagaatgccattggttgaatctgtgaagttgactaaatctgttgccactgccattgaaaacaaagatttcgataaggcaatttctttaagagacacagaatttattgaactttacgaaaacttcttatccactaccgttaaagatgatggttccgaattattgccagtatctgacagactaaacattggtattgtccatgttggtgccccatctgctgctttgaacgctgccacccgtgccgcaactctatactgtttgtctcacggccataaaccatacgctatcatgaatggtttcagtggattgattcaaaccggtgaagtgaaggaactatcatggattgatgtcgaaaactggcataacttgggtggttccgaaatcggtacgaacagatctgttgcttcagaagatttgggtaccattgcttactacttccaaaagaacaagctagacggtttgattattcttggtggttttgaaggtttcaggtccttgaagcaattgcgtgacggtagaacccaacacccaatctttaacattccaatgtgtttgattccagccactgtttctaacaacgttccaggtactgaatactcacttggtgttgatacctgtttgaacgcattagtcaattacactgatgacatcaaacagagtgcttctgcgacaagaagaagagtcttcgtctgtgaagtccaaggtggtcactctggttacatcgcttctttcactggtttaatcactggtgctgtttcagtgtacactccagaaaagaagatcgacttagcttctatcagagaagatataactctattaaaagagaactttcgtcacgacaaaggtgaaaacagaaacggtaagctattggttagaaacgaacaagcttctagcgtatatagcactcaattgttggctgacatcatctctgaagcaagcaagggtaagtttggtgttagaactgctatcccaggccatgttcaacaaggtggtgttccatcttctaaagaccgtgtcaccgcttccagatttgctgtcaaatgtatcaagtttatcgaacaatggaacaagaaaaatgaagcttctccaaacactgacgctaaggttttgagattcaagttcgatactcacggtgaaaaggtaccaactgttgagcacgaagatgactctgctgctgttatctgtgttaatggttctcacgtttccttcaagccaattgctaacctttgggaaaacgaaaccaacgttgaattaagaaagggttttgaagttcactgggctgaatacaacaagattggtgacatcctgtccggtagattaaagttgagagctgaggtagccgctttagccgctgaaaacaaatga

SEQ ID NO: 614 - DNA, 1080 bp, Saccharomyces cerevisiae
atgggtgttgaacaaatcttaaagagaaagaccggtgtcatcgttggtgaagatgtccacaacttattcacttacgctaaggaacacaagttcgctattccagctattaacgtcacctcttcttctactgccgtcgctgctttagaagctgctagagacagcaagtccccaatcattttgcaaacctctaacggtggtgctgcttacttcgctggtaagggtatctctaacgaaggtcaaaatgcttccatcaagggtgctattgccgctgcccactacatcagatccattgctccagcttacggtatcccagttgtcttacactctgaccactgtgccaagaagttgttgccatggttcgatggtatgttggaagctgatgaagcttacttcaaggaacacggtgaaccattattctcctcccacatgttggatttgtctgaagaaaccgatgaagaaaacatctctacttgtgtcaagtacttcaagagaatggccgctatggaccaatggttagaaatggaaatcggtattaccggtggtgaagaagatggtgttaacaacgaaaacgctgacaaggaagacttgtacaccaagccagaacaagtttacaacgtctacaaggctttgcacccaatctctccaaacttctccattgctgctgctttcggtaactgtcacggtttgtacgctggtgacatcgctttgagaccagaaatcttggctgaacaccaaaagtacaccagagaacaagttggttgcaaggaagaaaagccattgttcttggtcttccacggtggttccggttctactgtccaagaattccacactggtattgacaacggtgttgtcaaggtcaacttggacactgactgtcaatacgcttacttgactggtatcagagactacgtcttgaacaagaaggactacataatgtccccagtcggtaacccagaaggtccagaaaagccaaacaagaagttcttcgacccaagagtctgggttagagaaggtgaaaagaccatgggtgctaagatcaccaagtctttggaaactttccgtaccactaacactttataa

SEQ ID NO: 615 - DNA, 768 bp, Saccharomyces cerevisiae; identical to SEQ ID NO: 205

SEQ ID NO: 616 - DNA, 999 bp, Saccharomyces cerevisiae
atgatcagaattgctattaacggtttcggtagaatcggtagattggtcttgagattggctttgcaaagaaaagacattgaggttgttgctgtcaacgatccatttatctctaacgattatgctgcttacatggtcaagtacgattctactcatggtagatacaagggtactgtttcccatgacgacaagcacatcatcattgatggtgtcaagatcgctacctaccaagaaagagacccagctaacttgccatggggttctctaaagatcgatgtcgctgttgactccactggtgttttcaaggaattggacaccgctcaaaagcacattgacgctggtgccaagaaggttgtcatcactgctccatcttcttctgctccaatgtttgttgttggtgttaaccacactaaatacactccagacaagaagattgtctccaacgcttcttgtaccaccaactgtttggctccattggccaaggttatcaacgatgctttcggtattgaagaaggtttgatgaccactgttcactccatgaccgccactcaaaagactgttgatggtccatcccacaaggactggagaggtggtagaaccgcttccggtaacattatcccatcctctaccggtgctgctaaggctgtcggtaaggtcttgccagaattgcaaggtaagttgaccggtatggctttcagagtcccaaccgtcgatgtttccgttgttgacttgactgtcaagttggaaaaggaagctacttacgaccaaatcaagaaggctgttaaggctgccgctgaaggtccaatgaagggtgttttgggttacaccgaagatgccgttgtctcctctgatttcttgggtgacactcacgcttccatcttcgatgcctccgctggtatccaattgtctccaaagttcgtcaagttgatttcctggtacgataacgaatacggttactccgccagagttgttgacttgatcgaatatgttgccaaggcttaa

SEQ ID NO: 617 - DNA, 1200 bp, Saccharomyces cerevisiae
atgtctttatcttcaaagttgtctgtccaagatttggacttgaaggacaagcgtgtcttcatcagagttgacttcaacgtcccattggacggtaagaagatcacttctaaccaaagaattgttgctgctttgccaaccatcaagtacgttttggaacaccacccaagatacgttgtcttggcttctcacttgggtagaccaaacggtgaaagaaacgaaaaatactctttggctccagttgctaaggaattgcaatcattgttgggtaaggatgtcaccttcttgaacgactgtgtcggtccagaagttgaagccgctgtcaaggcttctgccccaggttccgttattttgttggaaaacttgcgttaccacatcgaagaagaaggttccagaaaggtcgatggtcaaaaggtcaaggcttccaaggaagatgttcaaaagttcagacacgaattgagctctttggctgatgtttacatcaacgatgccttcggtaccgctcacagagctcactcttctatggtcggtttcgacttgccacaacgtgctgccggtttcttgttggaaaaggaattgaagtacttcggtaaggctttggagaacccaaccagaccattcttggccatcttaggtggtgccaaggttgctgacaagattcaattgattgacaacttgttggacaaggtcgactctatcatcattggtggtggtatggctttcaccttcaagaaggttttggaaaacactgaaatcggtgactccatcttcgacaaggctggtgctgaaatcgttccaaagttgatggaaaaggccaaggccaagggtgtcgaagtcgtcttgccagtcgacttcatcattgctgatgctttctctgctgatgccaacaccaagactgtcactgacaaggaaggtattccagctggctggcaagggttggacaatggtccagaatctagaaagttgtttgctgctactgttgcaaaggctaagaccattgtctggaacggtccaccaggtgttttcgaattcgaaaagttcgctgctggtactaaggctttgttagacgaagttgtcaagagctctgctgctggtaacaccgtcatcattggtggtggtgacactgccactgtcgctaagaagtacggtgtcactgacaagatctcccatgtctctactggtggtggtgcttctttggaatta

SEQ ID NO: 618 - DNA, 744 bp, Saccharomyces cerevisiae
atgccaaagttagttttagttagacacggtcaatccgaatggaacgaaaagaacttattcaccggttgggttgatgttaaattgtctgccaagggtcaacaagaagccgctagagccggtgaattgttgaaggaaaagaaggtctacccagacgtcttgtacacttccaagttgtccagagctatccaaactgctaacattgctttggaaaaggctgacagattatggattccagtcaacagatcctggagattgaacgaaagacattacggtgacttacaaggtaaggacaaggctgaaactttgaagaagttcggtgaagaaaaattcaacacctacagaagatccttcgatgttccacctcccccaatcgacgcttcttctccattctctcaaaagggtgatgaaagatacaagtacgttgacccaaatgtcttgccagaaactgaatctttggctttggtcattgacagattgttgccatactggcaagatgtcattgccaaggacttgttgagtggtaagaccgtcatgatcgccgctcacggtaactccttgagaggtttggttaagcacttggaaggtatctctgatgctgacattgctaagttgaacatcccaactggtattccattggtcttcgaattggacgaaaacttgaagccatctaagccatcttactacttggacccagaagctgccgctgctggtgccgctgctgttgccaaccaaggtaagaaataa

SEQ ID NO: 619 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataa

SEQ ID NO: 620 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgttccatctggtgcctccaccggtgtccacgaagctttggaaatgagagatgaagacaaatccaagtggatgggtaagggtgttatgaacgctgtcaacaacgtcaacaacgtcattgctgctgctttcgtcaaggccaacctagatgttaaggaccaaaaggccgtcgatgacttcttgttgtctttggatggtaccgccaacaagtccaagttgggtgctaacgctatcttgggtgtctccatggccgctgctagagccgctgctgctgaaaagaacgtcccattgtaccaacatttggctgacttgtctaagtccaagacctctccatacgttttgccagttccattcttgaacgttttgaacggtggttcccacgctggtggtgctttggctttgcaagaattcatgattgctccaactggtgctaagaccttcgctgaagccatgagaattggttccgaagtttaccacaacttgaagtctttgaccaagaagagatacggtgcttctgccggtaacgtcggtgacgaaggtggtgttgctccaaacattcaaaccgctgaagaagctttggacttgattgttgacgctatcaaggctgctggtcacgacggtaaggtcaagatcggtttggactgtgcttcctctgaattcttcaaggacggtaagtacgacttggacttcaagaacccagaatctgacaaatccaagtggttgactggtgtcgaattagctgacatgtaccactccttgatgaagagatacccaattgtctccatcgaagatccatttgctgaagatgactgggaagcttggtctcacttcttcaagaccgctggtatccaaattgttgctgatgacttgactgtcaccaacccagctagaattgctaccgccatcgaaaagaaggctgctgacgctttgttgttgaaggttaaccaaatcggtaccttgtctgaatccatcaaggctgctcaagactctttcgctgccaactggggtgttatggtttcccacagatctggtgaaactgaagacactttcattgctgacttggttgtcggtttgagaactggtcaaatcaagactggtgctccagctagatccgaaagattggctaagttgaaccaattgttgagaatcgaagaagaattgggtgacaaggctgtctacgccggtgaaaacttccaccacggtgacaagttgtaa

SEQ ID NO: 621 - DNA, 1503 bp, Saccharomyces cerevisiae
atgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaa

SEQ ID NO: 622 - DNA, 1263 bp, Saccharomyces cerevisiae
atgcttgctgcttcattcaaacgccaaccatcacaattggtccgcgggttaggagctgttcttcgcactcccaccaggataggtcatgttcgtaccatggcaactttaaaaacaactgataagaaggcccctgaggacatcgagggctcggacacagtgcaaattgagttgcctgaatcttccttcgagtcgtatatgctagagcctccagacttgtcttatgagacttcgaaagccaccttgttacagatgtataaagatatggtcatcatcagaagaatggagatggcttgtgacgccttgtacaaggccaagaaaatcagaggtttttgccatctatctgttggtcaggaggccattgctgtcggtatcgagaatgccatcacaaaattggattccatcatcacatcttacagatgtcacggtttcacttttatgagaggtgcctcagtgaaagccgttctggctgaattgatgggtagaagagccggtgtctcttatggtaagggtggttccatgcacctttacgctccaggcttctatggtggtaatggtatcgtgggtgcccaggttcctttaggtgcaggtttagcttttgctcaccaatacaagaacgaggacgcctgctctttcactttgtatggtgatggtgcctctaatcaaggtcaagtttttgaatctttcaacatggccaaattatggaatttgcccgtcgtgttttgctgtgagaacaacaagtacggtatgggtaccgccgcttcaagatcctccgcgatgactgaatatttcaagcgtggtcaatatattccaggtttaaaagttaacggtatggatattctagctgtctaccaagcatccaagtttgctaaggactggtgtctatccggcaaaggtcctctcgttctagaatatgaaacctataggtacggtggccattctatgtctgatcccggtactacctacagaactagagacgagattcagcatatgagatccaagaacgatccaattgctggtcttaagatgcatttgattgatctaggtattgccactgaagctgaagtcaaagcttacgacaagtccgctagaaaatacgttgacgaacaagttgaattagctgatgctgctcctcctccagaagccaaattatccatcttgtttgaagacgtctacgtgaaaggtacagaaactccaaccctaagaggtaggatccctgaagatacttgggacttcaaaaagcaaggttttgcctctagggattaa

SEQ ID NO: 623 - DNA, 1101 bp, Saccharomyces cerevisiae
atgttttccagactgccaacatcattggccagaaatgttgcacgtcgtgccccaacttcttttgtaagaccctctgcagcagcagcagcattgagattctcatcaacaaagacgatgaccgtcagagaggccttgaatagtgccatggcggaagaattggaccgtgatgatgatgtcttccttattggtgaagaagttgcacaatataacggggcttataaggtgtcaaagggtttattggacaggttcggtgaacgtcgtgtggttgacacacctattaccgaatacgggttcacaggtttggccgttggtgccgctttgaagggtttgaagccaattgtagagtttatgtcgttcaatttctctatgcaagctatcgatcatgttgtcaattccgctgcaaagactcactacatgtctggtggtactcaaaaatgtcaaatggtcttcagaggtcctaatggtgctgcagtgggtgttggtgctcaacattcacaggacttttctccttggtacggttccattccagggttaaaggtccttgtcccttattctgctgaagatgctaggggtttgttaaaggccgccatcagagatccaaaccctgttgtatttttagagaacgaattgttgtacggtgaatcttttgaaatctcagaagaagctttatcccctgagttcaccttgccatacaaggctaagatcgaaagagaaggtaccgatatttccattgttacgtacacaagaaacgttcagttttctttggaagccgctgaaattctacaaaagaaatatggtgtctctgcagaagttatcaacttgcgttctattagacctttagatactgaagctatcatcaaaactgtcaagaagacaaaccacttgattactgttgaatccactttcccatcatttggtgttggtgctgaaattgtcgcccaagttatggagtctgaagcctttgattacttggatgctccaatccaaagagttactggtgccgatgttccaacaccttacgctaaagaattagaagatttcgctttccctgatactccaaccatcgttaaagctgtcaaagaagtcttgtcaattgaataa

SEQ ID NO: 624 - DNA, 1500 bp, Saccharomyces cerevisiae
atgttaagaatcagatcactcctaaataataagcgtgccttttcgtccacagtcaggacattgaccattaacaagtcacatgatgtagtcatcatcggtggtggccctgctggttacgtggctgctatcaaagctgctcaattgggatttaacactgcatgtgtagaaaaaagaggcaaattaggcggtacctgtcttaacgttggatgtatcccctccaaagcacttctaaataattctcatttattccaccaaatgcatacggaagcgcaaaagagaggtattgacgtcaacggtgatatcaaaattaacgtagcaaacttccaaaaggctaaggatgacgctgttaagcaattaactggaggtattgagcttctgttcaagaaaaataaggtcacctattataaaggtaatggttcattcgaagacgaaacgaagatcagagtaactcccgttgatgggttggaaggcactgtcaaggaagaccacatactagatgttaagaacatcatagtcgccacgggctctgaagttacacccttccccggtattgaaatagatgaggaaaaaattgtctcttcaacaggtgctctttcgttaaaggaaattcccaaaagattaaccatcattggtggaggaatcatcggattggaaatgggttcagtttactctagattaggctccaaggttactgtagtagaatttcaacctcaaattggtgcatctatggacggcgaggttgccaaagccacccaaaagttcttgaaaaagcaaggtttggacttcaaattaagcaccaaagttatttctgcaaagagaaacgacgacaagaacgtcgtcgaaattgttgtagaagatactaaaacgaataagcaagaaaatttggaagctgaagttttgctggttgctgttggtagaagaccttacattgctggcttaggggctgaaaagattggattagaagtagacaaaaggggacgcctagtcattgatgaccaatttaattccaagttcccacacattaaagtggtaggagatgttacatttggtccaatgctggctcacaaagccgaagaggaaggtattgcagctgtcgaaatgttgaaaactggtcacggtcatgtcaactataacaacattccttcggtcatgtattctcacccagaagtagcatgggttggtaaaaccgaagagcaattgaaagaagccggcattgactataaaattggtaagttcccctttgcggccaattcaagagccaagaccaaccaagacactgaaggtttcgtgaagattttgatcgattccaagaccgagcgtattttgggggctcacattatcggtccaaatgccggtgaaatgattgctgaagctggcttagccttagaatatggcgcttccgcagaagatgttgctagggtctgccatgctcatcctactttgtccgaagcatttaaggaagctaacatggctgcctatgataaagctattcattgttga

SEQ ID NO: 625 - DNA, 1449 bp, Saccharomyces cerevisiae
atgtctgcctttgtcagggtggttccaagaatatccagaagttcagtactcaccagatcattgagactgcaattgagatgctacgcatcgtacccagagcacaccattattggtatgccggcactgtctcctacgatgacgcaaggtaatcttgctgcttggactaagaaggaaggtgaccaattgtctcccggtgaagttattgccgaaatagaaacagacaaggctcaaatggactttgagttccaagaagatggttacttagccaagattctagttcctgaaggtacaaaggacattcctgtcaacaagcctattgccgtctatgtggaggacaaagctgatgtgccagcttttaaggactttaagctggaggattcaggttctgattcaaagaccagtacgaaggctcagcctgccgaaccacaggcagaaaagaaacaagaagcgccagctgaagagaccaagacttctgcacctgaagctaagaaatctgacgttgctgctcctcaaggtaggatttttgcctctccacttgccaagactatcgccttggaaaagggtatttctttgaaggatgttcacggcactggaccccgcggtagaattaccaaggctgacattgagtcatatctagaaaagtcgtctaagcagtcttctcaaaccagtggtgctgccgccgccactcctgccgccgctacctcaagcactactgctggctctgctccatcgccttcttctacagcatcatatgaggatgttccaatttcaaccatgagaagcatcattggagaacgtttattgcaatctactcaaggcattccatcatacatcgtttcctccaagatatccatctccaaacttttgaaattgagacagtccttgaacgctacagcaaacgacaagtacaaactgtccattaatgacctattagtaaaagccatcactgttgcggctaagagggtgccagatgccaatgcctactggttacctaatgagaacgttatccgtaaattcaagaatgtcgatgtctcagtcgctgttgccacaccaacaggattattgacaccaattgtcaagaattgtgaggccaagggcttgtcgcaaatctctaacgaaatcaaggaactagtcaagcgtgccagaataaacaaattggcaccagaggaattccaaggtgggaccatttgcatatccaatatgggcatgaataatgctgttaacatgtttacttcgattatcaacccaccacagtctacaatcttggccatcgctactgttgaaagggtcgctgtggaagacgccgctgctgagaacggattctcctttgataaccaggttaccataacagggacctttgatcatagaaccattgatggcgccaaaggtgcagaattcatgaaggaattgaaaactgttattgaaaatcctttggaaatgctattgtga

SEQ ID NO: 626 - DNA, 1461 bp, Saccharomyces cerevisiae
atggtacaaaggcttctaccgggcgcacatatatgcagaaggtccttcaattcgtctgcaattataaagtcttctgcattgactctcaaggaagcattagaaaacgtgatacctaagaaaagagatgctgtgaagaaattgaaggcctgttatggcagcacgtttgtcggaccgattaccatttcatcagttctaggtgggatgagaggtaatcagtcaatgttttggcaaggaacatcattagatcccgaacatggcattaaatttcaaggtttaacgattgaagaatgtcaaaatagattacctaatacaggtattgatggcgataatttcctgccagaatcaatgttatggctgttgatgacaggtggtgtgccaactttccagcaagctgcttctttcaggaaagaattggctattcgtggaaggaaattgccacattatacagagaaagttttgtcaagtttacccaaagatatgcaccctatgacccaacttgcaattggtttagcatcaatgaacaaaggatccctctttgctacaaactaccaaaagggcctcataggaaagatggaattttggaaagatactcttgaagattcgctaaatttaattgcttcactcccgctgctgactgggagaatttattcgaacattacaaatgagggacacccattaggtcaatatagtgaggaggtggattggtgtacaaacatatgttccctgctcggcatgacaaatggaacgaactcttctaatacatgcaaccttacttcccagcaatccctggacttcataaacttgatgcggttatataccggtatacatgtagaccatgaaggtggtaatgtttctgctcacaccacccacttggttggaagtgcgttgagtgacccgtatctcagctattcatctggaataatgggattagcgggtcctttgcatgggttagcagcacaagaagtagtaaggtttctcatagagatgaactctaatatttccagcattgcacgagaacaagaaatcaaagattatctttggaaaattttgaattcaaaccgtgtgatccccggttatgggcacgcagttttgcgtaaaccggatcctcgatttacagcaatgcttgaatttgcgcaaaagaggcctattgaatttgagaacgacaagaacgttttgttgatgcaaaaattggcagaaatagcgcctaaggttttgttggaacacggaaagagtaagaatccatttcccaatgttgactctgcatcggggattttgttttatcattatggaatcagggaattattattctttaccgtcatttttgggtgttcaagggccatgggacccttgacacaacttgtttgggatcgcattctaggtttaccaattgaaaggcccaagagtttgaacttggagggtctggaagcacttaccaaagcaagcaatgttaacaagttgtaa

SEQ ID NO: 627 - DNA, 2337 bp, Saccharomyces cerevisiae
atgctgtctgcacgttctgccatcaagagacccattgttcgtggtcttgcgacagtctccaacttgactagagattcaaaagtcaaccaaaacttattagaagatcattcttttattaactacaagcagaatgtggaaacgctggatatcgtaagaaaaagattaaacaggccatttacctacgcggaaaagattttgtacggtcacttggatgaccctcatggtcaagatattcagagaggtgtttcatacctaaaattaagaccagatcgtgttgcctgtcaagatgctactgctcaaatggctattttacaatttatgtccgctggtttaccacaggttgctaagccagtcactgtccactgtgaccatttgattcaagcacaagttggtggtgaaaaagatttgaagagagctatagatctaaacaaggaagtttatgatttcttggcctctgccactgcgaaatataacatgggtttctggaagccaggttccggtatcattcaccaaattgttctggaaaactacgctttcccaggtgctttgatcattggtactgactcccatacaccaaatgctggtggtttaggtcaattggctattggtgttggtggtgctgatgccgttgatgttatggcaggtcgtccatgggaattgaaggctccaaagatcttaggtgttaagttgactggtaagatgaacggttggacttctccaaaggatattattttgaaattggctggtatcacaactgtcaaaggtggtactggtaaaattgttgaatatttcggtgatggtgttgacaccttctccgctactggtatgggtaccatttgtaatatgggtgctgaaatcggtgctaccacatctgttttcccattcaacaaatctatgattgaatatttggaagcaactggtcgtggtaagatcgctgactttgctaaattataccacaaggacctattatctgctgataaggatgctgaatacgatgaggtcgtcgaaattgacttgaacactctggaaccatacatcaatgggccatttacccccgatttggctactccagtttctaagatgaaggaagttgctgttgctaataactggccattggatgtcagagtcggtttgatcggttcttgtaccaattcctcttatgaagatatgtctcgttcagcatccattgtcaaggatgctgctgctcatggtttgaaatccaagaccattttcactgttactccaggttctgaacaaatcagagccactattgaacgtgatggccaattagaaaccttcaaagaatttggtggtatcgttttggcaaacgcctgtggcccatgtattggtcaatgggatcgtagagatatcaagaaaggtgacaagaatactatcgtttcctcttacaacagaaatttcacttctagaaatgatggtaacccacaaactcatgcttttgttgcatctccagaattagtaactgcgttcgccattgcgggtgatttgagattcaaccctctaacagacaaattaaaggacaaggatggtaatgagttcatgttgaaaccaccacatggtgatggtttgcctcaaagaggttatgatgctggtgagaacacttaccaagctccacctgcagaccgtagcaccgttgaagttaaagtttctccaacttcagaccgtctacaactgttgaaaccattcaaaccttgggatggtaaggatgctaaagacatgccaatcttgattaaggccgtcggtaagacaactactgatcatatttctatggctggtccatggttgaaatacagaggtcatttagaaaacatttctaataactatatgattggtgctattaatgctgaaaacaagaaggctaactgtgttaaaaatgtatatactggtgaatacaaaggtgttccagacactgctagagattacagagaccaaggtatcaagtgggttgttattggtgatgaaaactttggtgaaggttcctctcgtgaacacgctgctttggaaccaagattcttgggcggtttcgctatcatcacaaagtctttcgctcgtatccatgaaactaacttgaaaaaacaaggtctattgccattgaacttcaagaacccagctgactatgacaagatcaaccctgatgacagaatcgatattctgggtctagctgaattggctccaggtaagcctgtaacaatgagagttcatccaaagaatggtaagccatgggatgctgtgttgacccatactttcaacgatgagcaaattgaatggttcaaatatggttctgccttaaataaaattaaggccgatgagaagaaataa

SEQ ID NO: 628 - DNA, 990 bp, Saccharomyces cerevisiae
atgttaagatctaccgtttcaaaagcttctctcaaaatttgtcgtcactttcacagagaatctattccttacgataagacgatcaaaaatttgctgcttcccaaggacaccaaggtgatctttcaggggttcacaggtaaacaaggtacttttcatgccagcatctctcaagaatatggtacaaatgttgtgggtggtacgaacccaaaaaaggcgggtcaaacacatttaggccaacctgtctttgcctctgtgaaggacgcgattaaggagactggagccactgccagtgccatctttgttcctccaccgatcgcagctgctgccattaaagaatctattgaagctgaaattccgttagctgtatgtatcactgaaggtattcctcaacatgacatgttatacattgcagaaatgttgcagacacaagataaaacaagattagttgggcccaactgccctggtatcattaacccagcaacaaaggtaagaattggtatccagcccccaaaaatttttcaagctggtaaaatcggtattatttccagatcgggaactttgacatacgaagctgttcagcaaactacaaaaactgaccttggtcaatcactggttattggtatgggtggtgatgcttttcccggtactgattttattgacgccttgaaattatttctagaagatgaaactacagaaggtattattatgttaggtgaaataggtggtaaggccgaaatcgaagctgctcaatttctcaaagaatacaactttagcaggagtaagccgatgccggtggcatctttcatcgcaggaactgttgctggtcaaatgaaaggtgttagaatgggtcactccggtgcaattgtagaaggatctggaactgatgcagaatccaaaaaacaagctttgagagatgttggtgttgccgtcgttgaatctccaggttacttaggtcaagctttactggatcaatttgccaaatttaaatga

SEQ ID NO: 629 - DNA, 1284 bp, Saccharomyces cerevisiae
atgtactcaagaaaatccttatccctaatttcaaagtgtgggcaattaagcaggctaaacgcgcaagctgctttacaagcaaggagacacttgtcaattcatgaatacaggtcagctcagttattgagggaatacggtattggtactccagaaggatttccagcgttcactcccgaagaggctttcgaagcagccaagaaattaaacactaacaaactggtcatcaaggcgcaggcattgaccggaggtagaggtaaaggtcacttcgacaccggttacaaaagcggtgttcacatgatcgaaagtcctcagcaggcagaggatgttgcaaaagaaatgctcaatcataacctgattactaaacagacgggaatagcggggaagccagtatctgctgtatatatagtgaaaagagtagatacaaagcatgaagcttatttatctattctaatggacagacaaaccaagaaaccgatgatcattgcgtccagtcaaggtggtatgaatattgaagaggtggctgagagaaccccagatgctataaagaaattttcaattgaaacttcaaagggattgagcccacaaatggccaaggatgttgccaagagtctcggtttcagtcccgatgcacaagacgaggcagcaaaagctgtttccaatttgtataaaatattcatggaaagggatgctacacaagtggagattaaccctttgagtgaaattgaacatgatccaacccacaaaatcatgtgtacagacgccaaatttgggtttgatgataacgcatcattcagacaggaaaagatatattcctggagggacttatcacaagaagatcctgatgaagttaaggcaaagaagtatgatttgaattttgttaagttgaagggtaacattggatgtttagtcaatggtgctggtttggctatggctactatggatgtcatcaaattaaatggaggcgatcctgcgaactttttggattgtggtggtggtgccacccctgagaccatcaaacaaggtttcgaattgatcttatccaataagaacgtagatgcaattttcgtcaatattttcggcggtatcgtaagatgtgactatgttgccctggggctggtagaagccgccagagaactagaagttagggtccccattgtggcacgtttgcaaggtaccaaagtagaagaaggccgcgacattatcaataagtcaggcgtgaagatttattcgtttgatgaattagatcctgctgctaaaaaggtcgttgaattgacccaaaattaa

SEQ ID NO: 630 - DNA, 1923 bp, Saccharomyces cerevisiae
atgctatcgctaaaaaaatcagcgctctccaagttgactttgctcagaaacacaagaacatttacatcgtcagctttggtgcgccaaacgcagggctctgtaaacggttccgcgtccagatctgcagacgggaagtaccacataatagatcacgagtatgactgtgtggtaatcggtgccggtggtgccggccttagagcggcctttggtcttgccgaggcgggctacaagactgcttgtatatccaagcttttccccaccagatcccacactgttgctgctcagggtggtatcaatgccgctctgggaaatatgcacaaggataactggaaatggcatatgtacgatactgtgaaaggatctgattggctaggtgaccaggactccatccattacatgaccagggaagcgcccaaatcgatcattgaactggaacactatggtgttcctttttcaagaactgaaaacggtaagatctaccaaagagcctttggtggtcagaccaaggagtacggtaagggtgctcaggcctatagaacatgcgctgtcgcagacaggacaggacatgctcttttacacacgctttatggccaagctttaagacatgacacacatttctttattgagtactttgccctcgatctgttgacccataatggcgaggtcgttggtgtcatcgcttataatcaggaagacggtaccatccacagattcagagcacacaagaccattattgccactggtggctatggtagagcatacttctcttgtacctctgctcacacatgtacgggtgacggtaatgccatggtttcgcgtgctggtttccccttgcaagatttagagtttgttcaattccatccttcaggtatatatgggtctggttgcttaatcactgaaggtgctcgtggtgaaggtggttttttggttaattctgaaggtgaaagattcatggaacgttacgctcctacggccaaggatctagcttgtagagatgtcgtttccagagcaatcaccatggagatcagagaaggcagaggtgttggtaagaaaaaggaccacatgtacttacaattgagccatctacctccggaagttctaaaggaaagattgccaggtatctctgaaacagcagccatttttgctggtgtagacgtcaccaaggaacctattcccattattcctaccgtccactataacatgggtggtattcccacgaagtggaatggtgaggcattaaccattgatgaagaaactggcgaagacaaggttattcccggtttaatggcttgtggtgaagccgcttgtgtttctgtccatggtgccaatagattaggtgccaattccttgttggatcttgttgtctttggtcgtgctgttgcccatacggttgctgacactttacagcctgggttgccacacaaaccactaccttctgatttgggtaaagaatccatcgcaaacttggataaactaagaaatgctaatggttcaagatctacggcagaaattagaatgaatatgaaacaaactatgcaaaaggatgtttccgtctttagaacacaatcatctttagatgaaggtgttcggaacattactgcagtagagaagacctttgatgatgtgaagacgaccgatagatcaatgatctggaattctgacttggttgaaactctggagctacagaacttattaacctgtgcctcccaaacagctgtttccgctgctaatagaaaggaatcccgtggtgctcatgcaagagaggattatccaaatagagatgacgaacattggatgaagcatacattatcctggcaaaaggacgtcgctgccccagtgactttgaaatacagaagggttatcgatcacactttggacgaaaaggaatgtccttccgtacctccaactgtaagagcctactaa

SEQ ID NO: 631 - DNA, 801 bp, Saccharomyces cerevisiae
atgttgaacgtgctattgagaaggaaggccttttgtttggtgacgaagaagggtatggctactgccacaacagctgcagctacgcatacccccagattgaaaacttttaaagtttacagatggaatccagacgagccaagtgctaaacctcatttacagtcatatcaagtggatctgaatgactgtgggcccatggtacttgatgcgctgttaaagatcaaagacgaacaggattctaccctaacttttagaagatcatgtagagaaggtatctgcggttcatgtgccatgaacattggcggtagaaacacgctagcttgtatatgtaagatcgaccagaacgaatccaaacaactcaagatctatccattaccccacatgtttattgtcaaagatttggtacctgatttaactaacttctaccaacaatacaaatctatccaaccttacttacagagatcatcgtttccaaaggatggaacggaagtgctacaaagtattgaagatcgtaagaaactggatggtctttacgaatgtattctgtgtgcatgctgctctacttcatgtccatcgtactggtggaaccaagaacagtatttgggccctgccgtgctaatgcaagcctaccgttggctaattgactctagagaccaagctacaaagacaagaaaggccatgctaaacaactccatgtcattgtacagatgtcacaccatcatgaactgtactagaacttgtccaaagggcttgaatcctggtttggctattgctgaaattaagaaatctttggcatttgcctag

SEQ ID NO: 632 - DNA, 597 bp, Saccharomyces cerevisiae
atgtctgcaatgatggtcaagttaggactgaataagtcggctctattactgaaaccctccgccttttcaagagcagctgccttgagctcctcgaggaggctgctttttaatacagctagaacaaacttcctttctacctcaccattgaagaatgtggccagtgaaatgaacaccaaagcggcaattgctgaagaacaaatattaaacaagcaaagagcaaagagacctatttctccacatctgaccatttaccagccacaattaacttggtacctgtcttctcttcaccgtatttcgttggtgcttatgggactaggtttctacttgtttactatactcttcggagtctctggtttattaggtcttggattgactaccgaaaaggtttctaattggtaccatcagaagttttccaagattaccgaatggtccatcaagggttcctttgcttacttatttgcaattcactatggtggcgccattagacacttgatctgggataccgctaaggaattgacattgaaaggcgtttacagaactggttacgctctcattggtttcaccgccgttctcggtacttatttattaactttatga

SEQ ID NO: 633 - DNA, 546 bp, Saccharomyces cerevisiae
atgatgttgccaagatccatgaaatttatgactggaaggagaattttccatactgccacagtaagggccttccagtctaccgctaagaagagcttaactatcccatttttgcccgtattaccccagaaaccaggtggtgttaggggcactcccaatgatgcctacgtccccccccctgagaataaattagagggctcataccactggtatatggaaaaaatctttgccttgtccgtcgttccattggctacgacggctatgctgacaaccggtccgttatccactgcagctgattctttcttttctgtcatgcttttgggatattgttacatggaatttaactcttgtatcaccgattatatttctgaaagagtttatggtgtttggcacaagtacgccatgtatatgttgggccttggttctgcggtctccctttttggaatctataaactagaaaccgagaatgatggtgttgttggtttagtaaaaagtctatgggattcttccgagaaagacaacagtcaaaagattgaagccaagaagtag

SEQ ID NO: 634 - DNA, 1467 bp, Saccharomyces cerevisiae
atgttgagatttaccaattgtagttgcaagactttcgtaaaatcgtcatataagcttaatataagaagaatgaactcctcgttcagaactgaaaccgatgcatttggtgagatacacgtgcctgctgataagtactggggtgcccaaactcaaagatcctttcaaaacttcaagattggtggcgctcgtgaaagaatgccattgcctttggtgcatgcatttggtgttttgaagaaatctgccgcgattgtgaatgagtctctggggggattggatcccaagatctccaaggctattcaacaggccgctgacgaagtggcttctggtaagctagacgaccactttccattggttgttttccaaacgggttccggtacccagtctaacatgaatgctaatgaagttatttccaatcgtgccattgagatcctaggaggcaagattggatctaaacaagtccatccaaacaatcattgcaaccaatctcaatcatccaatgatactttccccactgtcatgcatatcgctgccagtttgcaaattcaaaacgagttgatacctgagttgaccaatttaaagaacgcccttgaagccaaatccaaggaatttgaccatattgtgaagatcggtagaacacacttgcaagatgccacgcctttgacactaggtcaagagttttccggttacgtgcaacaagttgagaacggtatccaaagagtggcacattctttgaaaacattgagtttcctggcacaaggtggtactgccgttggtacagggttgaacaccaagcccggattcgatgtcaagatagccgagcaaatttccaaagaaactggactaaagtttcaaaccgcccctaataagttcgaggctttggctgctcacgacgccattgtcgaatgtagcggtgctctaaacacccttgcttgttctcttttcaaaatagcgcaagatataagatacttagggtccgggccacgttgcggctaccatgaactaatgctgccagagaatgaaccaggttcctcaatcatgcctggtaaagttaacccaacccaaaacgaggcattgactcaagtgtgtgtgcaagtcatgggtaacaatgcagctatcacgtttgccggctctcaaggtcaattcgagttaaatgtcttcaagccagtcatgatcgccaatctattgaattcgatcaggttaattactgatgccgcatattcatttagagtgcactgtgttgaaggtatcaaagccaatgagcctcgtattcatgagttgttgactaaatctttaatgttagtcaccgctttgaaccctaagatcggttatgatgccgcttccaaggtcgccaagaatgctcataagaagggcattaccttgaaggaaagtgcattggaattgggtgtattgactgaaaaggaatttgatgaatgggttgttcctgaacacatgctaggtcctaaataa

SEQ ID NO: 635 - DNA, 1005 bp, Saccharomyces cerevisiae
atgttgtcaagagtagctaaacgtgcgttttcctctacagttgccaacccttataaagtgactgttttgggtgcaggcggtggtattggacaaccattgtctttgcttctaaagcttaaccataaagtcacggacttaagactgtacgacctaaagggcgcaaaaggtgttgccaccgatttgtctcatattccaacaaactccgtggtcaaggggtttactccagaagagccagacggattgaacaacgctttaaaggacacagacatggttttaattcctgctggtgtgcccagaaagcctggtatgacacgtgatgacttgttcgccatcaacgcaagcatcgttcgcgatttggcagcagcaaccgccgaatccgctcccaatgctgccattctggtcatttccaacccagtcaattctaccgttccaattgtcgcccaagtcttgaaaaacaagggtgtttacaacccaaagaaattgttcggtgtgactaccttggactctattagagccgccagattcatctcagaagtcgagaacaccgatccaactcaggaaagggttaacgtcatcggtggacattctggtattaccatcatcccattgatttcgcaaacaaaccataagttgatgtctgatgacaagagacacgaattgattcacagaatacagtttggtggtgacgaagtcgtcaaagcaaagaatggtgctggctctgctacgttgtcaatggcccatgctggtgctaaattcgctaacgctgttttgtccggtttcaaaggcgaaagagacgtcatcgagccttccttcgtggactctcccttgttcaaatccgaaggcatcgaattctttgcatctccggtcactttgggcccagatggtattgaaaagatccatccaataggtgagttatcttcagaagaagaagaaatgctacaaaaatgtaaagaaaccttgaagaagaatatcgaaaagggtgtcaactttgttgctagtaaatag

SEQ ID NO: 636 - DNA, 1134 bp, Saccharomyces cerevisiae
atgcctcactcagttacaccatccatagaacaagattcgttaaaaattgccattttaggtgctgccggtggtatcgggcagtcgttatcgctgcttttgaaagctcagttgcaataccagttaaaggagagcaaccggagcgttacccacattcatctggctctttacgatgtcaaccaagaagccatcaacggtgttaccgccgacttgtctcatatagacacccccatttccgtgtcgagccactctcctgcaggtggcattgagaactgtttgcataacgcttctattgttgtcattcctgcaggtgttccaagaaaacctggcatgactcgtgatgacttatttaacgtgaatgctggtatcattagccagctcggtgattctattgcagaatgttgtgatctttccaaggtcttcgttcttgtcatttccaaccctgttaattctttagtcccagtgatggtttctaacattcttaagaaccatcctcagtctagaaattccggcattgaaagaaggatcatgggtgtcaccaagctcgacattgtcagagcgtccacttttctacgtgagataaacattgagtcagggctaactcctcgtgttaactccatgcctgacgtccctgtaattggcgggcattctggcgagactattattccgttgttttcacagtcaaacttcctatcgagattaaatgaggatcaattgaaatatttaatacatagagtccaatacggtggtgatgaagtggtcaaggccaagaacggtaaaggtagtgctaccttatcgatggcccatgccggttataagtgtgttgtccaatttgtttctttgttattgggtaacattgagcagatccatggaacctactatgtgccattaaaagatgcgaacaacttccccattgctcctggggcagatcaattattgcctctggtggacggtgcagactactttgccataccattaactattactacaaagggtgtttcctatgtggattatgacatcgttaataggatgaacgacatggaacgcaaccaaatgttgccaatttgcgtctcccagttaaagaaaaatatcgataagggcttggaattcgttgcatcgagatctgcatcatcttaa

SEQ ID NO: 637 - DNA, 1032 bp, Saccharomyces cerevisiae
atggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttccaagctatga

SEQ ID NO: 638 - DNA, 1674 bp, Saccharomyces cerevisiae
atgcctatccccgttggaaatacgaagaacgattttgcagctttacaagcaaaactagatgcagatgctgccgaaattgagaaatggtggtctgactcacgttggagtaagactaagagaaattattcagccagagatattgctgttagacgcgggacattcccaccaatcgaatacccatcttcggtcatggccagaaaattattcaaggtattagagaagcatcacaatgagggtacagtctctaaaactttcggtgccctagatcctgtccagatttctcaaatggcaaaatacttagacacaatctatatttctggttggcagtgttcatcaactgcttccacctcaaatgaacctggtccagacttagctgattatccaatggacaccgttccaaacaaagtggaacatttgttcaaggcccaattgtttcacgacagaaaacaactagaggcacggtcaaaggctaaatctcaggaagaactcgatgagatgggtgccccaattgactacctaacaccaattgtcgctgatgcagacgcaggccacggcggtttaaccgcagtcttcaaattgaccaagatgttcattgagcgtggtgctgctgggatccacatggaagaccagacatctacaaataagaaatgtgggcatatggcaggaagatgtgttatacccgttcaggaacatgttaacagattggtgactattagaatgtgtgctgatatcatgcattctgacttaattgtcgttgctaggactgattcagaagcagccactttgattagctcaaccatcgataccagagatcattatttcattgtcggtgccaccaatccaaatatcgagccatttgccgaagttttaaatgatgccatcatgagtggtgcatcaggacaagaactagctgacattgaacaaaaatggtgtagagacgctggactcaagttattccatgaagccgtcattgatgaaattgaaagatcagccctgtcaaataagcaagaattgattaagaaattcacctctaaagtgggtccattgactgaaacatcccacagagaagccaagaagctcgctaaagaaattcttggccacgaaattttcttcgactgggagctaccacgcgtaagggaagggttgtaccgttacagaggtgggacgcaatgttctatcatgagggcccgtgcatttgctccatatgctgatttggtatggatggaatctaactacccagacttccaacaggccaaggagtttgcagaaggtgttaaagagaaattccctgaccaatggctagcttacaacttgtctccatcctttaactggccaaaagccatgtccgttgatgaacaacacaccttcatccaaaggctgggtgatctaggttacatctggcaatttatcacattggccggtttacacactaacgctttagctgtccataacttctctcgtgactttgccaaggatgggatgaaagcttatgcccagaatgttcagcagagggaaatggacgatggtgttgatgtgttgaaacatcaaaaatggtctggtgcggagtacatcgatgggttattgaagttagctcaaggtggtgttagcgcaacagctgctatgggaaccggtgtcacagaagatcaattcaaagaaaatggcgtaaagaaatag

SEQ ID NO: 639 - DNA, 1665 bp, Saccharomyces cerevisiae
atggttaaggtcagtttggataacgtcaaattactggtggatgttgataaggagcctttctttaaaccatctagtactacagtgggagatattcttaccaaggatgctctagagttcattgttcttttacacagaactttcaacaacaagagaaaacaattattggaaaacagacaagttgttcagaagaaattagactcgggctcctatcatctggatttcctgcctgaaactgcaaatattagaaatgatcccacttggcaaggtccaattttggcaccggggttaattaataggtcaacggaaatcacagggcctccattgagaaatatgctgatcaacgctttgaatgctcctgtgaacacctatatgactgattttgaagattcagcttcacctacttggaacaacatggtttacggtcaagttaatctctacgacgcgatcagaaatcaaatcgattttgacacaccaagaaaatcgtacaaattgaatggaaatgtggccaacttgcccactattatcgtgagaccccgtggttggcacatggtggaaaagcacctttatgtagatgatgaaccaatcagcgcttccatctttgattttggtttatatttctaccataatgccaaagaattaatcaaattgggcaaaggtccttacttctatttgccaaagatggagcaccacttggaagctaaactatggaacgacgtcttctgtgtagctcaagattacattgggatcccaaggggtacaatcagagctactgtgttgattgaaactttgcctgctgctttccaaatggaagagatcatctatcaattaagacaacattctagtgggttgaattgcggacgttgggactatattttctctacaatcaagagattaagaaatgatcctaatcacattttgcccaatagaaatcaagtgactatgacttccccattcatggatgcatacgtgaaaagattaatcaatacctgtcatcggaggggtgttcatgccatgggtggtatggctgcgcaaatccctatcaaagacgacccggcagccaatgaaaaggccatgactaaagtccgtaatgataagattagagagctgacaaatggacatgatgggtcatgggttgcacacccagcactggcccctatttgtaatgaagttttcattaatatgggaacaccaaaccaaatctatttcattcctgaaaacgttgtaacggctgctaatctgctggaaaccaaaattccaaatggtgagattactaccgagggaattgtacaaaacttggatatcgggttgcagtacatggaagcttggctcagaggctctggatgtgtgcccatcaacaacttgatggaagacgccgccactgctgaagtgtctcgttgtcaattgtatcaatgggtgaaacacggtgttactctaaaggacacgggagaaaaggtcaccccagaattaaccgaaaagattctaaaagaacaagtggaaagactgtctaaggcaagtccattgggtgacaagaacaaattcgcgctggccgctaagtatttcttgccagaaatcagaggcgagaaattcagtgaatttttgactacattgttgtacgacgaaattgtgtccactaaggcgacgcccactgatttgagcaaattgtga

SEQ ID NO: 640 - DNA, 1665 bp, Saccharomyces cerevisiae
atggtgaagataagcttggacaacactgctctatacgcagacatcgacacgactcctcaatttgaaccttccaaaactactgtagctgatattttaacaaaagatgccttagagttcattgttttgctgcatagaactttcaattcaacacggaaacagcttttagccaacagaagcaatttacaatcaaagttagactctggtgaataccgatttgatttcttgccggaaaccgaacaaatcaggaacgatcctacatggcaaggtgctatcccagcccctggtttgatcaacagatccagcgagattactgggccaccattgagaaatatgttagtcaacgctttgaatgctgaagtaacgacatatatgactgatttcgaggactcttcatctccaacttgggagaacatgatttacggacaagttaatctttatgatgccattagaaatcaaatcgatttcaagacaccaagaaaggagtacaggttgaaggatgacatttcaagactgcccactttaattgtcagacctcgtggctggcacatggtggagaagcacctttacatagatgatgaaccgattagtgcttccatcttcgattttggtttatatttttaccataacgctaaagagttagttaaaattggtaaaggaccttatttttacttaccaaagatggagcaccatatggaggtaaaactatggaatgacatattctgtgttgcacaagattttattggaatgccccgcggtaccattagggccactgttctgattgaaactttgccagcggccttccaaatggaggagattatctatcaaataagagaacattcaagcggtttgaactgtggtcgttgggactacatattttcgaccattaaaaaactgagaaacttgcctgaacacgttttgccaaatagggatctagtgactatgacttcaccttttatggatgcttatgtgaaaagattgatcaatacatgtcaccgtagaggggtccatgcgatgggtggtatggctgcccaaatccccataaaagatgatccaaaggctaatgaagctgcaatgaacaaagttcgtaatgacaaaattagagaaatgaagaatgggcatgatgggtcatgggtagcacacccagcattggcaccgatttgtaatgaagttttcagtaacatgggtacagcaaatcaaatatattttgtcccggatgtacatgttacatcatctgatttattgaatacgaagattcaagatgctcaagtcactactgagggaatcagagtaaacttggatattggcctacaatatatggaggcttggttaaggggatctggttgtgtcccaattaatcatttgatggaagatgccgctactgcggaagtatcacgttgtcaattgtaccagtgggttaaacatggtgttgtcttaagtgataccggtgacaaagtaactccagaattgaccgctaagatattaaatgaagagactgcaaaattggcttcagcaagtccgctgggtgaaaagaacaagtttgccttggcagccaagtattttttgcctgaagtcactggtaaaatctttagcgacttcttgaccactttattgtatgatgaaattattaagccaagtgccaaaccagttgacttaagtaaattatag

SEQ ID NO: 641 - DNA, 3537 bp, Saccharomyces cerevisiae
atgtcgcaaagaaaattcgccggcttgagagataacttcaatctcttgggtgaaaagaacaaaatattggtggctaatagaggagaaattccaatcagaatttttcgtaccgctcatgaactgtctatgcagacggtagctatatattctcatgaagatcgtctttcaacgcacaaacaaaaggctgacgaagcatacgtcataggtgaagtaggccaatatacccccgtcggcgcttatttggccattgacgaaatcatttccattgcccaaaaacaccaggtagatttcatccatccaggttatgggttcttgtctgaaaattcggaatttgccgacaaagtagtgaaggccggtatcacttggattggccctccagctgaagttattgactccgtgggtgataaggtctcagctagaaacctggcagcaaaagctaatgtgcccaccgttcctggtacaccaggtcctatagaaactgtagaggaagcacttgacttcgtcaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggccgataaccacggaaacgtggttcatcttttcgaaagagactgttccgtgcagagaagacaccaaaaggttgtcgaagtggccccagcaaagactttaccccgtgaagtccgtgacgccattttgacagatgcagttaaattggccaaagagtgtggctacagaaatgcgggtactgctgaattcttggttgataaccaaaatagacactatttcattgaaattaatccaagaatccaagtggaacataccatcacagaagaaattaccggtatagatattgtggcggctcagatccaaattgcggcaggtgcctctctaccccagctgggcctattccaggacaaaattacgactcgtggctttgccattcagtgccgtattaccacggaagaccctgctaagaacttccaaccagataccggtagaatagaagtgtaccgttctgcaggtggtaatggtgttagactggatggtggtaacgcctatgcaggaacaataatctcacctcattacgactcaatgctggtcaaatgctcatgctccggttccacctacgaaatcgttcgtagaaaaatgattcgtgcattaatcgagttcagaattagaggtgtcaagaccaacattcccttcctattgactcttttgaccaatccagtatttattgagggtacatactggacgacttttattgacgacaccccacaactgttccaaatggtttcatcacaaaacagagcccaaaaacttttacattacctcgccgacgtggcagtcaatggttcatctatcaagggtcaaattggcttgccaaaattaaaatcaaatccaagtgtcccccatttgcacgatgctcagggcaatgtcatcaacgttacaaagtctgcaccaccatccggatggaggcaagtgctactagaaaaggggccagctgaatttgccagacaagttagacagttcaatggtactttattgatggacaccacctggagagacgctcatcaatctctacttgcaacaagagtcagaacccacgatttggctacaatcgctccaacaaccgcacatgcccttgcaggtcgtttcgccttagaatgttggggtggtgccacattcgatgttgcaatgagatttttgcatgaggatccatgggaacgtttgagaaaattaagatctctggtgcctaatattccattccaaatgttattgcgtggtgccaatggtgtggcttattcttcattgcctgacaatgctattgaccatttcgtcaagcaagccaaggataatggtgttgatatatttagagtctttgatgccttaaatgacttggaacaattgaaggtcggtgtagatgctgtgaagaaggcaggtggtgttgtagaagccactgtttgtttctctggggatatgcttcagccaggcaagaaatacaatttggattactacttggaaattgctgaaaaaattgtccaaatgggcactcatatcctgggtatcaaagatatggcaggtaccatgaagccagcagctgccaaactactgattggatctttgagggctaagtaccctgatctcccaatacatgttcacactcacgattctgcaggtactgctgttgcatcaatgactgcgtgtgctctggcgggcgccgatgtcgttgatgttgccatcaactcaatgtctggtttaacttcacaaccatcaatcaatgctctgttggcttcattagaaggtaatattgacactggtattaacgttgagcatgtccgtgaactagatgcatattgggcagagatgagattgttatactcttgtttcgaggctgacttgaagggcccagatccagaagtttatcaacatgaaatcccaggtggtcaattgacaaacttgttgtttcaagcccaacaattgggtcttggagaacaatgggccgaaacaaaaagagcttacagagaagccaattatttattgggtgatattgtcaaagttaccccaacttcgaaggtcgttggtgatctggcacaatttatggtctccaataaattaacttccgatgatgtgagacgcctggctaattctttggatttccctgactctgttatggatttcttcgaaggcttaatcggccaaccatatggtgggttcccagaaccatttagatcagacgttttaaggaacaagagaagaaagttgacttgtcgtccaggcctggaactagagccatttgatctcgaaaaaattagagaagacttgcagaatagatttggtgatgttgatgagtgcgacgttgcttcttataacatgtacccaagagtttatgaagacttccaaaagatgagagaaacgtatggtgatttatctgtattgccaacaagaagctttttgtctccactagagactgacgaagaaattgaagttgtaatcgaacaaggtaaaacgctaattatcaagctacaggctgtgggtgatttgaacaaaaagaccggtgaaagagaagtttactttgatttgaatggtgaaatgagaaaaattcgtgttgctgacagatcacaaaaagtggaaactgttactaaatccaaagcagacatgcatgatccattacacattggtgcaccaatggcaggtgtcattgttgaagttaaagttcataaaggatcactaataaagaagggccaacctgtagccgtattaagcgccatgaaaatggaaatgattatatcttctccatccgatggacaagttaaagaagtgtttgtctctgatggtgaaaatgtggactcttctgatttattagttctattagaagaccaagttcctgttgaaactaaggcatga

SEQ ID NO: 642 - DNA, 3543 bp, Saccharomyces cerevisiae
atgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatcccaaaaaaagtaa

SEQ ID NO: 643 - DNA, 1284 bp, Saccharomyces cerevisiae
atgcgtaagtgtaaaatttttgttggtaactctcacccagagttgggtaatatggtttgccaaagattaggtatcgaaccagctccatgtacattaaaaaaatttgcaaatggtgaaacgtcagttcaaatcggtgtatctgttcgtgacgaagatgtgtatgtcattcaatctggttctccatccataaatgatgacattatggaactgttgattttagtttctgcctgtaggggcggatctgctaggaaaattacagcagtcattcctcaatttccttactctaaacaatgtaaaatgaagagacacagaggcgctattactgcaaggatgttggccaatctgttggtcatggctggcgctgatcatgttgtgtctatggaccttcatgcttctcaaatgcaggggtttttcaccaaaccagtcgataacctatacgggggccctagtttagcgaaatggattagagaaaatgttgaagactatgaagatgcagtagttgtctctaagaatccaggtggtactaaaagagttacagccctggcggattctttgaagatcaactttgctatgatccatactgatcgtcgtcgttctaaggatctgtattctcaaaacaaggatttgcaacaactaaagttgagaaagcaatcaatgttgaggaaaaatagaccgatcatcagacaaggtgaccatccaaatgaggaggaaaacattattttaagtaacggtattcaaactgctaggatccgtaacggccacgttatcggtgacgatgaggcagacgatgatgaagacgctatcttagaatctgacagcgaattgcattctattgatggcttagactcgcatggcttgggcggtacatatgatgctgtcgactccgaagacgaagaggaaatcccagttctctatagggaacaactgattacattggtcggaaacgtccgtggtcgctctgccatcattctagatgatatgattgatagacctgggtcatttattagcgctgctgaacatttggtgcaaaattgtggtgccaaaaaggtttatgttgttgctactcacggtatattcactggagactgtttggaagaacttgaaaagtccgatgccattgacacaattgtggtcacaaatacatatccgatttctggcgaacgcatagctgggtccaagaaattggttactatcgatgtttctccaattttcgcagaatgtatccgtcgtgatcattatggtgagagtatttccgttttatttgactctttggcagctctgtaa

SEQ ID NO: 644 - DNA, 957 bp, Saccharomyces cerevisiae
atgtctacaaacagtattaagttgttagctggtaactcacatcctgggcttgctgagcttatttcccaaaggcttggtgtaccgttatctaaagtgggggtatatcagtattcaaataaagagacgtctgttacaataggggaaagcattcgtgatgaagacgtatatatcatccaaactggttacggggaacatgaaatcaacgatttcttaatggaattacttatcttaattcacgcttgtaagacggcatcagtcagaagaattacggcagtaataccaaatttcccttatgctagacaagataagaaggataaatcgcgggcgcccatcactgcgaagctgattgccaatcttttggaaactgcgggttgtgatcatgttattactatggatctccatgcttcacaaattcaagggttttttcatatcccggttgataatttatacggtgaaccaagtgtgttgaattacataaggaccaaaacagatttcaataatgcgatactggtatcgcctgatgctggtggtgcgaaaagggtggcttctttagcggacaagctggatatgaattttgccttgattcataaggagaggcaaaaagctaatgaagtttcgcgaatgctgcttgtcggtgatgttgctggtaagtcatgcttgttgattgacgatatggctgacacgtgtggtacgctggtgaaagcctgtgacacattaatggatcacggtgctaaggaggttatcgctattgtcacacatggtatattttctggctcagctagggagaagttaataaatagtaggttatcaagaattgtttgcaccaacacggtacctgttgatttggatttggacattgtcgatcaggtggatatcagccctacgattgcagaagctatcagaagattgcataatggagaatcagtctcatatttatttacacatgcgcctgtttaa

SEQ ID NO: 645 - DNA, 963 bp, Saccharomyces cerevisiae
atgccaacaaattccatcaaattattagcaccagatgtccaccgaggtttagctgaacttgttgccaaaaggctaggtctacagttaacaagcagcaaactaaagagagatccaaccggtgaggtttccttttctattggagaatctgttagggaccaagatatctttatcatcacgcaaattggctctggtgtcgtgaacgatcgtgttctagaactactgatcatgatcaatgcttcgaagactgcgtctgcaagaagaatcactgctattattccaaatttcccatatgcaagacaagatagaaaggataagtctcgtgctcctattaccgctaaattgatggccgatatgttaacaacagccgggtgtgatcatgttattactatggatttgcatgcttcccaaattcaagggttcttcgacgtcccagtagataatttatatgcagaaccaagcgtagttaggtatatcaaggaaaatgtcaactatatggattcaataataatttcgccagatgctggtggggcaaaacgtgctgccactttggctgatcgtttggatctaaattttgcattgatccataaggaaagagctcgtgccaatgaggtttctcgtatggttcttgttggggatgttactgataagatttgtatcattgttgatgatatggccgatacttgtggtactttagctaaggctgctgaaattcttttggagaatagagctaaatctgttattgctattgtcacgcacggtgttttatcaggcagagctattgaaaatattaacaattctaaactggatagagttgtttgcacaaatactgttccatttgaagaaaaaatcaagaagtgcccaaaactggcagtcattgacatcagtagtgtgctggctgaaagtattcgtcgtttgcataatggtgaaagtatttcttatttatttaagaattatcccttataa

SEQ ID NO: 646 - DNA, 984 bp, Saccharomyces cerevisiae
atgaattcagagtctcgagaagatatggctataaatagtatcaaattgctagcgggaaactcccatcctgatttggctgaacaaatatcgaaaaagttaggtattccactttccaaagttggtgtgtaccagtattctaataaagaaacctctgtcaccataggtgagagccttcgcgacgaagatgtgtatattatccaaactggaataggtgaacaagaaattaatgatttcttgatggaattattaattttaattcatgcttgccaaattgcatctgcaagaaagatcactactgtaatacccaattttccatatgcaagacaagacaagaaagataaatcccgggcgcccattaccgcaaagttggttgccaatttattgcaaactgctggtgctgatcatgtcatcacaatggatctccatgcctcccaaattcaagggtttttccatatcccggttgacaacctatatgcagaaccaagtgttttaaattatattagagcccggaaaacagatttcgacaatgctattttggtgtcgcctgatgcaggtggtgctaagagagtagctgctttggctgacaagttagatttaaattttgctttgattcacaaagagaggcaaaaagctaacgaggtttcaaaaatggtgcttgttggtgatgttaccaataaatcatgtttattagttgatgatatggcggatacttgtggtacgttggtaaaagcttgtgatacgttgatggagcatggtgccaaagaagttatagctattgttacacacggtattttctccggttcagcaagagaaaagctaagaaatagtagattgtctagaattgtttgcacaaataccgttccggtagatttggatttacctattgctgaccagatcgatattagtcccacgttcgctgaagctataagaagactacacaatggtgaatccgtgtcatatttgttcacccatgctccagtatag

SEQ ID NO: 647 - DNA, 1491 bp, Saccharomyces cerevisiae
atgtcaatgagtaatattgttgtttttggaggggactcgcaccccgagttagttactaagatctgtgaaaatttggacattcacccatcgaaagtagaattagggaagttttctaatggggaaacgaacattgctcttcgcgaatctgttcgtgaaaaggatgtatatatcatccagagtggttgtggccaggtgaacgacacgttcatgcagttgctgattttaatcagtgcctgcaagtccgcttctgcctcgagggttacagccgtaatgccatatctctgctactcgagacagccagatattccatatactgccaagggtgctcccataatttccaagcctaaagaaaactatacttttgaatcgcatccaggcacacccgtgtcatcttctttaatgacgcaaagaccaggtgctgagagctcgttgaagagtttggatagtgcaatacgatcaactatcaacttagaaaatcctcaacctatcagaacaccaaacagcagtgctacggcgaataacaatttcgacatcaagaagacgctttctttttcaagaattcctatgattcccggtggtaagttacaaaatacaagcaatagcacggacgctggtgaattgttcaacgctcaaaatgcaggctataagctatgggtagtacaagccggtactttgattgctcatttgttgagtgctgcaggtgctgaccatgtgatcacaatggatttgcacgatccacagttccctgggttttttgacattccagtggataatctctactgtaaacccattgcacaaaactacatccagcatcgcattccagattatcaggatgctgtgatcgtttctccagatgctggtggtgcaaagagagctacggctattgcagacgccttggaattgtccttcgccctaattcataaagaaagaagatctcagttattgaagggccctccagatgcgacgttaacctctggtggttcgttaccagtatctccaaggccattagttactactttggtttcctcccaaaatactacttcttcaggtgccactggggttgcggcccttgaaatgaagaaaacaacttcaacatcttccacctcgtcgcaatcttctaattcgtccaagttcgttcaaactaccatgcttgttggcgatgttagaaacaaggtgtgtattatagtcgacgacttggtggatacttcatacactattacaagagctgcgaaattgttgaaggatcaaggatctaccaaagtttatgccttaataacgcacggtgttttttccggtgatgcgctagaaagaatcggccaaagtagtatagataagttgatcatttctaacacggttcctcaagatagaacactacagtacctaggtaaggacagagtggatgttattgatgtctcctgcataatcggtgaagcaattagaagaatccataacggtgaatccatttctatgttgttcgagcatggatggtag

SEQ ID NO: 648 - DNA, 1323 bp, Saccharomyces cerevisiae
atgtctgaaaataacgaattccagagtgtcaccgaatcgacgactgctccaaccactagtaacccatatggcccaaatcctgcggattatctatccaatgttaagaatttccagttgattgattcaacactaagagagggtgaacaatttgccaacgcattcttcgatactgaaaaaaagattgaaattgctagagccttggatgatttcggtgtggactacatcgagttaacctctcccgtagcatccgaacaatcaagaaaggactgtgaagctatatgtaaactaggtttaaaggccaagatccttacacacattcgttgtcacatggacgatgccagagtcgccgtagagactggtgtcgacggtgtcgatgttgttatcggcacctccaaatttttaagacaatattcccacggtaaggatatgaactacatcgccaagagtgctgttgaagtcattgaatttgtcaaatccaaaggtattgaaatcagattttcctctgaagattccttcagaagtgatctcgttgatcttttgaacatttataaaaccgttgacaagatcggtgtaaatagagtcggtattgccgacacagttggatgtgccaacccaagacaagtatatgaactgatcagaactttgaagagtgttgtctcatgtgacatcgaatgccatttccacaatgataccggttgtgccattgcaaacgcctacactgctttggaaggtggtgccagattgattgacgtcagtgtactgggtattggtgaaagaaacggtatcactcctctaggtgggctcatggcaagaatgattgttgccgcaccagactatgtcagatctaaatacaagctgcacaagatcagagacatcgaaaacctggtcgctgatgctgtggaagttaacattccattcaacaaccctatcaccgggttctgtgcattcacacataaagcaggtatccatgccaaggccattttggctaacccatctacctacgaaatcttggaccctcacgatttcggtatgaagagatatatccacttcgccaacagactaactggttggaatgcaatcaaatcaagagtcgaccaattgaacttgaatttgacggatgatcaaatcaaggaagttactgctaagattaagaagctgggtgatgtcagaccgctaaatattgatgatgtagactccattatcaaggacttccatgcagaattgagcaccccacttttaaaaccagtaaataagggtacagatgacgacaatatcgatatttccaatgggcatgtttctaaaaaggcaaaggtcaccaaatag

SEQ ID NO: 649 - DNA, 1287 bp, Saccharomyces cerevisiae
atgactgctgctaaaccaaatccatatgctgccaaaccgggcgactatctttctaatgtaaataatttccagttaatcgattcgacgctgagagaaggtgaacaatttgccaacgcattcttcgatactgaaaaaaagatcgaaattgctagagccttggacgatttcggtgtggactacatcgagttaacctcaccagtagcatctgaacaatcaagaaaggactgtgaagctatatgtaaactaggtttaaaggccaagatccttacacacattcgttgtcatatggatgacgccaaagtcgccgtagagactggtgtcgacggtgtcgatgtcgttatcggcacctccaaatttttaagacaatattcccacggtaaggatatgaactacatcgccaagagtgctgttgaagtcattgaatttgtcaaatccaaaggtattgaaatcagattttcctctgaagattccttcagaagtgatctcgttgatcttttgaacatttataaaaccgttgacaagatcggtgtaaatagagtcggtattgccgacacagttggatgtgccaacccaagacaagtatatgaactgatcagaactttgaagagtgttgtttcatgtgacatcgaatgccatttccacaacgatactggttgtgccattgcaaacgcctacactgctttggaaggtggtgccagattgattgacgtcagtgtactgggtattggtgaaagaaacggtatcactcctctaggtgggctcatggcaagaatgattgttgccgcaccagactatgtcaagtccaaatacaagttgcacaagatcagagacattgaaaacctggtcgctgatgctgtggaagttaacattccattcaacaaccctatcaccgggttctgtgcattcacacataaagcaggtatccatgccaaggccattttggctaacccatctacctacgaaatcttggaccctcacgatttcggtatgaagaggtatatccacttcgccaacagactaactggctggaacgccatcaaagccagagtcgaccagttgaacttgaacttgacggatgaccaaatcaaggaagttactgctaagattaagaagctgggtgatgtcagatcgctgaatatcgatgatgttgactctatcatcaagaacttccacgcagaggtcagcactcctcaagtactatctgcaaaaaagaacaagaagaatgacagcgatgtaccggaactggccaccatccccgccgccaagcggactaagccatccgcctaa

SEQ ID NO: 650 - DNA, 1365 bp, Saccharomyces cerevisiae
atgtcagagccagaatttcaacaagcttacgaagaagttgtctcctctttggaagactctactcttttcgaacaacacccagaatacagaaaggttttgccaattgtttctgttccagaaagaatcatacaattcagagtcacctgggaaaatgacaagggtgaacaagaagttgctcaaggttacagagtgcaatataactccgccaagggtccatacaagggtggtctacgtttccatccttccgtgaacttgtctatcttgaaattcttgggtttcgaacaaatcttcaagaactccttgaccggcctagacatgggtggtggtaaaggtggtctatgtgtggacttgaagggaagatctaataacgaaatcagaagaatctgttatgctttcatgagagaattgagcagacacattggtcaagacactgacgtgccagctggtgatatcggtgttggtggtcgtgaaattggttacctgttcggtgcttacagatcatacaagaactcctgggaaggtgtcttaaccggtaagggtttgaactggggtggttctttgatcagaccagaagccactggttacggtttagtttactatactcaagctatgatcgactatgccacaaacggtaaggaatctttcgaaggtaagcgcgtcaccatctctggtagtggtaacgttgctcaatacgctgccttgaaggttattgagctaggtggtactgtcgtttccctatctgactccaagggttgtatcatctctgaaactggtatcacctccgaacaagtcgctgatatttccagtgctaaggtcaacttcaagtccttggaacaaatcgtcaacgaatactctactttctccgaaaacaaagtgcaatacattgctggtgctcgtccatggacccacgtccaaaaggtcgacattgctttgccatgtgccacccaaaatgaagtcagcggtgaagaagccaaggccttggttgctcaaggtgtcaagtttattgccgaaggttccaacatgggttccactccagaagctattgccgtctttgaaactgctcgttccaccgccactggaccaagcgaagctgtttggtacggtccaccaaaggctgctaacttgggtggtgttgctgtttctggtttagaaatggcacaaaactctcaaagaatcacatggactagcgaaagagttgaccaagagttgaagagaattatgatcaactgtttcaatgaatgtatcgactatgccaagaagtacactaaggacggtaaggtcttgccatctttggtcaaaggtgctaatatcgcaagtttcatcaaggtctctgatgctatgtttgaccaaggtgatgtattttaa

SEQ ID NO: 651 - DNA, 1374 bp, Saccharomyces cerevisiae
atgacaagcgaaccagagtttcagcaggcttacgatgagatcgtttcttctgtggaggattccaaaatttttgaaaaattcccacagtataaaaaagtgttacctattgtttctgtcccggagaggatcattcaattcagggtcacgtgggaaaatgataatggcgagcaagaagtggctcaaggatacagggtgcagttcaattcagccaagggcccttacaagggtggcctacgcttccacccatcagtgaacctgtctatcctaaaatttttgggttttgaacagatcttcaagaatgcgctcactgggctagatatgggcggtggtaagggtggcctgtgtgtggacttgaaaggcaagtctgacaacgagatcagaaggatttgttatgcgttcatgagagaactgagcaggcatattggtaaggacacagacgtgcccgcaggagatattggtgtcggtggccgtgaaattggctacctattcggcgcttacagatcatacaagaactcctgggaaggtgtgttgactggtaagggtttaaactggggtggctcacttatcaggccggaggccaccgggttcggcttagtttactatacgcaagcaatgatcgattatgcaacaaacggcaaggagtcgtttgagggcaaacgtgtgacaatctccggaagtggcaatgttgcgcaatatgcagctttgaaagtgatcgagctgggtggtattgtggtgtctttatccgattcgaaggggtgcatcatctctgagacgggcattacttctgagcaaattcacgatatcgcttccgccaagatccgtttcaagtcgttagaggaaatcgttgatgaatactctactttcagcgaaagtaagatgaagtacgttgcaggagcacgcccatggacgcatgtgagcaacgtcgacattgccttgccctgtgccacccaaaacgaggtcagtggtgacgaagccaaggccctagtggcatctggcgttaagttcgttgccgaaggtgctaacatgggttctacacccgaggctatttctgttttcgaaacagcgcgtagcactgcaaccaatgcaaaggatgcagtttggtttgggccaccaaaggcagctaacctgggcggcgtggcagtatccggtctggaaatggctcagaattctcaaaaagtaacttggactgccgagcgggtcgatcaagaactaaagaagataatgatcaactgcttcaacgactgcatacaggccgcacaagagtactctacggaaaaaaatacaaacaccttgccatcattggtcaagggggccaacattgccagcttcgtcatggtggctgacgcaatgcttgaccagggagacgttttttag

SEQ ID NO: 652 - DNA, 1494 bp, Saccharomyces cerevisiae
atgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctggcaaccatcattactttagaaaatggtaaagctctaggggaagctaaaggagaaatcaaatacgcggcttcgtattttgagtggtacgccgaggaagcaccccgtttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacactttatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaa

SEQ ID NO: 653 - DNA, 1257 bp, Saccharomyces cerevisiae
atgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 654 - DNA, 1356 bp, Saccharomyces cerevisiae
atgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataa

SEQ ID NO: 655 - DNA, 1113 bp, Saccharomyces cerevisiae
atgttcattaaaaacgatcacgccggtgacaggaaacgcttggaagactggagaatcaaaggttatgatccattaacccctccagatctgcttcaacatgaatttccaatttcagccaaaggtgaggaaaacattatcaaggcaagagactccgtctgtgatattttgaatggtaaagatgatcgtttagttatcgtgatcgggccatgttccctacatgaccccaaagccgcttacgattacgctgacagattggctaaaatttcagaaaagttgtcaaaagacttattgattattatgagagcgtatttagaaaaaccaaggactactgttggctggaaagggttgattaacgaccctgatatgaataactcttttcaaatcaataaaggtctacggatttcgagagaaatgttcataaaactggttgaaaaattacccattgctggtgagatgttggataccatttctccgcagtttttgagtgattgtttctccttgggtgccatcggcgccagaactactgaatcccaactgcacagagaattagcatccggtctatctttccctattggatttaagaacggtactgatggtggtttgcaagtcgccatcgacgctatgagagccgctgcacatgaacattacttcctttctgtcacaaagccaggtgtcactgctatcgtgggcactgaaggtaacaaggataccttcctgatcttgagaggtggtaagaacggtactaactttgacaaagaaagtgttcaaaatactaagaaacagttagaaaaggccggtttgactgatgattcccagaaaagaattatgatcgattgttcccacggcaacagtaataaagatttcaagaaccaaccaaaggttgccaaatgtatttatgaccagctgacggagggtgagaatagtctctgtggtgttatgattgagtccaacataaatgaaggtagacaagatattcccaaagaaggtggcagagagggattgaagtatggttgttctgttacggatgcttgtattggctgggagtccaccgaacaggtattggagctattggcagaaggtgttagaaacagaagaaaggccttgaaaaaatag

SEQ ID NO: 656 - DNA, 1113 bp, Saccharomyces cerevisiae
atgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatctagaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctcaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaatag

SEQ ID NO: 657 - DNA, 4767 bp, Saccharomyces cerevisiae
atggtgcagttagccaaagtcccaattctaggaaatgatattatccacgttgggtataacattcatgaccatttggttgaaaccataattaaacattgtccttcttcgacatacgttatttgcaatgatacgaacttgagtaaagttccatactaccagcaattagtcctggaattcaaggcttctttgccagaaggctctcgtttacttacttatgttgttaaaccaggtgagacaagtaaaagtagagaaaccaaagcgcagctagaagattatcttttagtggaaggatgtactcgtgatacggttatggtagcgatcggtggtggtgttattggtgacatgattgggttcgttgcatctacatttatgagaggtgttcgtgttgtccaagtaccaacatccttattggcaatggtcgattcctccattggtggtaaaactgctattgacactcctctaggtaaaaactttattggtgcattttggcaaccaaaatttgtccttgtagatattaaatggctagaaacgttagccaagagagagtttatcaatgggatggcagaagttatcaagactgcttgtatttggaacgctgacgaatttactagattagaatcaaacgcttcgttgttcttaaatgttgttaatggggcaaaaaatgtcaaggttaccaatcaattgacaaacgagattgacgagatatcgaatacagatattgaagctatgttggatcatacatataagttagttcttgagagtattaaggtcaaagcggaagttgtctcttcggatgaacgtgaatccagtctaagaaaccttttgaacttcggacattctattggtcatgcttatgaagctatactaaccccacaagcattacatggtgaatgtgtgtccattggtatggttaaagaggcggaattatcccgttatttcggtattctctcccctacccaagttgcacgtctatccaagattttggttgcctacgggttgcctgtttcgcctgatgagaaatggtttaaagagctaaccttacataagaaaacaccattggatatcttattgaagaaaatgagtattgacaagaaaaacgagggttccaaaaagaaggtggtcattttagaaagtattggtaagtgctatggtgactccgctcaatttgttagcgatgaagacctgagatttattctaacagatgaaaccctcgtttaccccttcaaggacatccctgctgatcaacagaaagttgttatcccccctggttctaagtccatctccaatcgtgctttaattcttgctgccctcggtgaaggtcaatgtaaaatcaagaacttattacattctgatgatactaaacatatgttaaccgctgttcatgaattgaaaggtgctacgatatcatgggaagataatggtgagacggtagtggtggaaggacatggtggttccacattgtcagcttgtgctgaccccttatatctaggtaatgcaggtactgcatctagatttttgacttccttggctgccttggtcaattctacttcaagccaaaagtatatcgttttaactggtaacgcaagaatgcaacaaagaccaattgctcctttggtcgattctttgcgtgctaatggtactaaaattgagtacttgaataatgaaggttccctgccaatcaaagtttatactgattcggtattcaaaggtggtagaattgaattagctgctacagtttcttctcagtacgtatcctctatcttgatgtgtgccccatacgctgaagaacctgtaactttggctcttgttggtggtaagccaatctctaaattgtacgtcgatatgacaataaaaatgatggaaaaattcggtatcaatgttgaaacttctactacagaaccttacacttattatattccaaagggacattatattaacccatcagaatacgtcattgaaagtgatgcctcaagtgctacatacccattggccttcgccgcaatgactggtactaccgtaacggttccaaacattggttttgagtcgttacaaggtgatgccagatttgcaagagatgtcttgaaacctatgggttgtaaaataactcaaacggcaacttcaactactgtttcgggtcctcctgtaggtactttaaagccattaaaacatgttgatatggagccaatgactgatgcgttcttaactgcatgtgttgttgccgctatttcgcacgacagtgatccaaattctgcaaatacaaccaccattgaaggtattgcaaaccagcgtgtcaaagagtgtaacagaattttggccatggctacagagctcgccaaatttggcgtcaaaactacagaattaccagatggtattcaagtccatggtttaaactcgataaaagatttgaaggttccttccgactcttctggacctgtcggtgtatgcacatatgatgatcatcgtgtggccatgagtttctcgcttcttgcaggaatggtaaattctcaaaatgaacgtgacgaagttgctaatcctgtaagaatacttgaaagacattgtactggtaaaacctggcctggctggtgggatgtgttacattccgaactaggtgccaaattagatggtgcagaacctttagagtgcacatccaaaaagaactcaaagaaaagcgttgtcattattggcatgagagcagctggcaaaactactataagtaaatggtgcgcatccgctctgggttacaaattagttgacctagacgagctgtttgagcaacagcataacaatcaaagtgttaaacaatttgttgtggagaacggttgggagaagttccgtgaggaagaaacaagaattttcaaggaagttattcaaaattacggcgatgatggatatgttttctcaacaggtggcggtattgttgaaagcgctgagtctagaaaagccttaaaagattttgcctcatcaggtggatacgttttacacttacatagggatattgaggagacaattgtctttttacaaagtgatccttcaagacctgcctatgtggaagaaattcgtgaagtttggaacagaagggaggggtggtataaagaatgctcaaatttctctttctttgctcctcattgctccgcagaagctgagttccaagctctaagaagatcgtttagtaagtacattgcaaccattacaggtgtcagagaaatagaaattccaagcggaagatctgcctttgtgtgtttaacctttgatgacttaactgaacaaactgagaatttgactccaatctgttatggttgtgaggctgtagaggtcagagtagaccatttggctaattactctgctgatttcgtgagtaaacagttatctatattgcgtaaagccactgacagtattcctatcatttttactgtgcgaaccatgaagcaaggtggcaactttcctgatgaagagttcaaaaccttgagagagctatacgatattgccttgaagaatggtgttgaattccttgacttagaactaactttacctactgatatccaatatgaggttattaacaaaaggggcaacaccaagatcattggttcccatcatgacttccaaggattatactcctgggacgacgctgaatgggaaaacagattcaatcaagcgttaactcttgatgtggatgttgtaaaatttgtgggtacggctgttaatttcgaagataatttgagactggaacactttagggatacacacaagaataagcctttaattgcagttaatatgacttctaaaggtagcatttctcgtgttttgaataatgttttaacacctgtgacatcagatttattgcctaactccgctgcccctggccaattgacagtagcacaaattaacaagatgtatacatctatgggaggtatcgagcctaaggaactgtttgttgttggaaagccaattggccactctagatcgccaattttacataacactggctatgaaattttaggtttacctcacaagttcgataaatttgaaactgaatccgcacaattggtgaaagaaaaacttttggacggaaacaagaactttggcggtgctgcagtcacaattcctctgaaattagatataatgcagtacatggatgaattgactgatgctgctaaagttattggtgctgtaaacacagttataccattgggtaacaagaagtttaagggtgataataccgactggttaggtatccgtaatgccttaattaacaatggcgttcccgaatatgttggtcataccgctggtttggttatcggtgcaggtggcacttctagagccgccctttacgccttgcacagtttaggttgcaaaaagatcttcataatcaacaggacaacttcgaaattgaagccattaatagagtcacttccatctgaattcaacattattggaatagagtccactaaatctatagaagagattaaggaacacgttggcgttgctgtcagctgtgtaccagccgacaaaccattagatgacgaacttttaagtaagctggagagattccttgtgaaaggtgcccatgctgcttttgtaccaaccttattggaagccgcatacaaaccaagcgttactcccgttatgacaatttcacaagacaaatatcaatggcacgttgtccctggatcacaaatgttagtacaccaaggtgtagctcagtttgaaaagtggacaggattcaagggccctttcaaggccatttttgatgccgttacgaaagagtag

SEQ ID NO: 658 - DNA, 817 bp, Saccharomyces cerevisiae
ccgccacagtttatcgcccgaaatgcagaataaagccttagaaaaagcgggattgccatttacctatatggccttcgaagtggataacgatagctttcctggagcaattgaaggattaaaagccctcaaaatgcgcggaactggtgtatcgatgccgaacaaacaactggcgtgtgaatatgttgatgaattaacaccagctgccaaactggtgggggccatcaacaccatcgttaatgatgatggctatctgcgtggctataacaccgacggcacgggccatattcgcgccattaaagagagcggttttgatatcaaaggcaaaacgatggtgctgttaggggccggtggtgcctcaacggcaattggcgcgcagggggcaattgaaggtttaaaagaaattaaactctttaaccgtcgggatgagttcttcgataaagccctcgccttcgcgcagcgggttaatgaaaacaccgattgtgtcgtcacggtcaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacattatggactggcaaagatttccctctggaatatgttaaacaggtcatggggttcggtgcctga

SEQ ID NO: 659 - DNA, 2364 bp, Saccharomyces cerevisiae
atgctgtccgatacaattgacacaaagcaacaacagcaacagcttcatgtcctgttcatagactcttatgattcattcacctacaatgtagtgagactaattgaacaacaaactgatatctcaccgggagtcaacgccgtgcacgtgacgacggtacatagtgatacgttccaatctatggatcagctattgccacttttgccgctttttgatgctatcgttgttggcccaggacctgggaatcccaacaatggtgcacaagatatgggtataatatctgagcttttcgagaatgccaatggaaagttagatgaagttccaatattgggtatatgtcttgggttccaagcaatgtgcttggctcaaggtgctgatgtcagtgagctaaatactatcaagcatgggcaagtgtatgaaatgcatttaaacgatgcagccagagcttgtggccttttttctggttatcccgatacgttcaaatctacgaggtaccattcattgcatgtcaatgccgaaggcattgacacccttttgcccttatgcacaaccgaagatgagaacggtattcttttgatgagtgctcaaacgaaaaataagccatggtttggcgtacagtaccacccggagtcatgttgttcagaattgggggggctgttagtcagtaactttctcaagttgagtttcataaataacgtgaagacaggaaggtgggaaaagaagaaacttaatggagagttttccgatatcctatctcgattggataggactattgatagagaccccatatacaaggtaaaagagaaatatccgaagggcgaggacacaacttacgttaagcagttcgaggtctctgaagacccgaaattgacatttgaaatttgcaacatcatacgagaagaaaaatttgtcatgtcatcttctgtgattagtgaaaatacgggtgaatggtctatcattgctttaccaaactccgcatcccaggtattcactcattatggagctatgaaaaagactacagttcattattggcaagatagtgaaattagttacaccttgttgaaaaagtgtctagatggtcaagattcggatttgcctggctcccttgaggtaatacatgaagataaatcccaattttggatcactttgggtaaatttatggagaataaaataatcgataaccacagagaaataccttttattggaggtcttgttggcattttaggttatgaaataggtcagtacattgcatgcggccgttgcaatgatgatgagaattcccttgttcccgacgccaaactagtttttatcaacaatagtatagtcattaatcacaagcaagggaagctttattgtatttctctggataatacatttccagtggcattagaacaatcattaagggacagttttgttagaaagaagaatattaagcaatccctgtcctggcccaagtatcttccagaggagatagacttcattataactatgcccgataaacttgactacgctaaggcgtttaagaaatgtcaggattatatgcataagggtgattcttatgaaatgtgtctcacaacgcaaaccaaagttgtaccatctgcggtgatagaaccctggaggattttccagaccttggtacaaagaaacccggctccattttcaagtttttttgagtttaaagacattattccccgccaagatgaaacgcctccagttttgtgcttcttaagtacttctccagaaaggtttttgaagtgggatgcagacacatgcgagctacgtcccatcaagggaactgtgaaaaaaggaccgcaaatgaacttggcaaaagccacacgaatcctgaagacaccaaaagaatttggtgagaacttaatgattttggacttaatcagaaatgacctttacgagttggttcctgacgttcgggtggaggagttcatgtccgtgcaagaatatgccaccgtttaccaactcgttagcgtcgtaaaggcacatggattgacctctgccagtaagaagacgagatattcaggcattgatgtccttaaacactcgcttcctccgggatctatgacgggagcccccaagaagattactgtgcaattattgcaggacaagatagaaagcaagctaaacaaacatgtcaatggtggagcacgtggtgtttacagcggtgtcacgggatattggtctgtgaattccaacggagattggtctgttaacattagatgtatgtattcctacaacggcggaaccagctggcaactcggtgcagggggggccataacagtcttaagcacactagatggcgaactagaggaaatgtacaacaagttggagagcaacttacaaattttcatgtag

SEQ ID NO: 660 - DNA, 1125 bp, Saccharomyces cerevisiae
atgtcactaatggacaattggaagactgatatggaaagttacgatgaaggaggcctagttgctaatccgaacttcgaggttctggccactttcaggtacgaccctggttttgcacgccagtcagcgtcaaagaaagagatctttgaaactccagaccctcgattaggtttgagagacgaagatattaggcagcagataattaatgaggattactcaagttatttacgagtaagggaggttaattccggcggtgaccttctcgaaaatattcagcatcctgatgcttggaagcatgattgcaagaccattgtgtgccagcgtgtagaagatatgctacaagtcatttatgaacgattttttttattagatgaacaataccaaagaataagaatagcattatcatactttaaaattgacttcagcacgtctctgaatgatttattgaagttattggttgaaaacttgattaattgtaaagaaggaaattcagagtatcacgaaaaaattcaaaaaatgatcaacgaaaggcaatgctataaaatgcgggtacttgtctctaagacaggagatatacgaattgaggcaattccaatgcctatggagcctatcctaaaattaacaaccgattatgacagtgtttccacatacttcatcaaaacgatgctcaatggatttttaattgatagcacaataaattgggatgttgttgtttcatctgaaccattgaacgcatcagctttcaccagttttaaaaccacttcaagagatcattacgctagggcgagagttcgcatgcaaactgctataaataacttaagaggttcagaacctacttcttctgtctcgcaatgcgaaattttattttccaacaaatctggcctgctgatggaaggttcaataacaaacgtggctgtaattcaaaaagatcctaacggttctaaaaagtatgtgacaccaagattagcaactggatgtttgtgcggaacaatgcgtcattatttattgcggctcggccttattgaagagggagatatagatataggaagccttaccgttggcaacgaagttttgcttttcaatggcgtcatgggatgcataaagggaacagtgaagacaaaatattga

SEQ ID NO: 661 - DNA, 2475 bp, Saccharomyces cerevisiae
atgtcaaagctattttctactgtcaattctgcaagacatagtgtaccactaggcggcatgagagattatgtgcacattaagaaactagagatgaatacagttcttgggcctgattcctggaatcaattaatgcctcagaaatgtctactaagcttagatatgggtacagattttagtaaatctgcggctacggatgatttgaaatattctctaaattatgcagttatttctcgtgatttgacgaatttcgtcagcaaaaaaaagaattggggttctgtttctaatttggctaaatctgtgtctcaatttgttatggacaaatattctggtgtcgagtgtctgaatttagaagtgcaggcggatacaacgcatattagaagtgaccacatatcttgtattattcaacaagaaagagggaatccagaatcacaggaatttgacgttgttaggatatctgagttaaaaatgttgactttgattggtgttttcacctttgagagacttaagaaacagtatgtaactttggatataaagttgccttggccaaagaaagccgaattgccaccgccagtgcaaagcataattgataacgttgtcaagtttgtggaggaatcaaatttcaagactgtggaagctcttgtagaatctgtgtcagctgttattgcccataacgagtattttcaaaagtttccagattcgcctttggtggtgaaggttttgaaattaaacgcaatcacagccacagaaggtgttggtgtaagctgtattagagagcccagggagattgcgatggtaaatattccatatctttcctccatacatgaatcgtctgatattaagttccaattgtcttcatcacaaaacactcctattgagggtaaaaatacatggaaaagagcgtttttagcgtttggttcaaacattggggaccgtttcaaacacattcaaatggcgttgcaattattatcaagggaaaaaacggttaaattacggaatatttcgtctatttttgaaagtgaaccaatgtatttcaaagatcaaacccctttcatgaatgggtgtgttgaggtggagacattactgaccccaagcgaattattaaaattgtgtaaaaaaattgaatatgaagagttgcaaagagtcaagcattttgataatggtccgagaacaatagatctggatattgttatgtttttgaatagcgccggagaagatattatagtaaatgaaccggatttgaatataccgcatcctagaatgctggagaggactttcgttcttgagccgttatgtgaattaatatcccccgttcaccttcatcctgtgacagcggaacccattgtagaccatttaaaacagttatacgacaaacagcatgatgaagataccttatggaaattagttccattgccttatcgtagtggtgtggagcctagatttttgaaattcaagaccgctacaaaacttgacgaatttactggagaaacaaacagaattactgtttcacctacatatatcatggctatcttcaacgctacaccagattcattttccgatggaggtgagcattttgcggacattgaaagtcaattgaatgatatcattaaattgtgtaaagacgcattatatttgcatgagagcgtcatcatcgacgttggagggtgttctaccaggcctaactctattcaggcgtctgaggaagaagaaatacgcaggtctatcccattaattaaggccattagagaaagcactgagttaccgcaagataaagtcatactatccattgatacttatcgttccaatgtcgctaaagaagcgattaaagttggagtggatattattaatgatatttcgggaggtttatttgacagcaacatgtttgccgtaattgcagagaacccagaaatttgttatattttatcacacacacgtggtgatatttcaacgatgaataggctggcgcattacgaaaattttgcattgggtgattctattcagcaagaatttgttcataataccgacattcagcagctagacgacttgaaagacaaaacagtgttaatcaggaatgttggtcaagaaattggcgaaaggtatatcaaagcgattgataatggagtaaagcgctggcaaattctaatcgaccctggacttggttttgctaagacctggaagcaaaacttacaaattattagacatatccccattttaaagaactactcattcaccatgaactcaaacaattcgcaagtgtatgttaacctcagaaatatgcccgttttattgggtccatcgcgcaaaaaattcattggacatatcacaaaagatgtggatgcgaagcaaagagactttgctactggagcggtggtagcgtcgtgtattggtttcggcagcgacatggttagggtccatgacgttaaaaattgttcgaagagcattaaattagcagatgctatttataaaggtttggaataa

SEQ ID NO: 662 - DNA, 1284 bp, Saccharomyces cerevisiae
atggccattgaattgggactttcccgtattacaaaactactagagcatttaggcaatccgcaaaactcacttagagtgctgcacattgcagggacaaatggtaaaggttcagtatgtacttacctatcttctgtgttgcaacaaaagtcctaccaaattggaaaatttaccactccacacttggtgcatgttactgattccattacaatcaacaataagccgattccgttagagagataccagaatattagattacaactagaagctttaaacaagtcacactctttaaaatgtacggaattcgagctattaacatgtaccgcattcaaatatttttatgatgtgcagtgccaatggtgtgtcatagaagtaggccttggcggaagacttgatgcgaccaatgttattccaggcgcaaataaggcatgttgtggtattactaaaatcagtttggatcatgaaagctttttaggtaacaccttgtctgaaatctctaaagagaaagcaggtataataacagaaggggtacccttcacagtgattgatggaaccaatgaggcaagtgttataaatgttgtgaaagaaagatgcaaggctttagggtctgaactatccgttacagattctcaacttaacggaaatatgattgacaccaactcctggggttgttttgacttggcaaaattgccactgaatggagaatatcagatatttaatctcagggtggccatgggtatgttagactacttacaaatgaacgaacttattgatattaccaagaatgaagtaagtacgagattggcgaaggttgattggccaggaaggttatatcgtatggattatcgctttgacaaagtaagtaataggacagtgcctatattaatggacggtgcccacaatggctcagctgcagtagagttagttaagtacctaagaaaggagtacggaaaccagcctttgacctttgtgatggcagtaacgcatgggaaaaacttggagccgctgctccagccattattgaggcctatagatcaagtaattcttactcggtttaataatgtggaaggtatgccctggattcatgccactgatcctgaagaaataaaagattttattttgactcaaggatacacaaaggagatagtgattgaaaatgatttacatcaggtattgccttctctggcgcatgtatcagacgagcaaagacggccaattgttgtatgcggttcactgtatttatgtggtgaattattacggattcacaatagtcacttgagaaactaa

SEQ ID NO: 663 - DNA, 771 bp, Saccharomyces cerevisiae
atggatttcacaaaaccagaaactgttttaaatctacaaaatattagagatgaattagttagaatggaggattcgatcatcttcaaatttattgagaggtcgcatttcgccacatgtccttcagtttatgaggcaaaccatccaggtttagaaattccgaattttaaaggatctttcttggattgggctctttcaaatcttgaaattgcgcattctcgcatcagaagattcgaatcacctgatgaaactcccttctttcctgacaagattcagaaatcattcttaccgagcattaactacccacaaattttggcgccttatgccccagaagttaattacaatgataaaataaaaaaagtttatattgaaaagattataccattaatttcgaaaagagatggtgatgataagaataacttcggttctgttgccactagagatatagaatgtttgcaaagcttgagtaggagaatccactttggcaagtttgttgctgaagccaagttccaatcggatatcccgctatacacaaagctgatcaaaagtaaagatgtcgaggggataatgaagaatatcaccaattctgccgttgaagaaaagattctagaaagattaactaagaaggctgaagtctatggtgtggaccctaccaacgagtcaggtgaaagaaggattactccagaatatttggtaaaaatttataaggaaattgttatacctatcactaaggaagttgaggtggaatacttgctaagaaggttggaagagtaa

SEQ ID NO: 664 - DNA, 1359 bp, Saccharomyces cerevisiae
atggtatcagaggataagattgagcaatggaaagccacaaaagtcattggtataattggtctgggtgatatgggcctattatacgctaataaatttacagatgctggatggggtgttatatgttgtgatagggaagaatattatgatgaactgaaagaaaaatatgcctcagctaaattcgaactggtgaaaaatggtcatttggtatccaggcaaagcgactatattatctatagtgttgaagcatccaatattagtaagatcgtcgcaacgtatggaccatcttctaaggttggaacaattgttgggggtcaaacgagttgtaagctgccggaaatcgaggctttcgaaaagtatttacccaaggactgcgacatcattaccgtgcattcccttcatgggcctaaagttaatactgaaggccaaccactagttattatcaatcacagatcacagtacccagaatcttttgagttcgttaattctgttatggcatgtttgaaaagtaagcaagtttatttgacatatgaagagcatgacaagattaccgctgatacacaagctgtgacacatgctgctttcttaagtatgggatctgcgtgggcaaagataaagatttatccttggactctgggtgtaaacaaatggtacggtggcctagaaaatgtgaaagttaatatatcactaagaatctattcgaacaagtggcatgtttacgcaggattagccataacaaacccaagtgcacatcagcaaattcttcaatatgcaaccagtgcaacagaactatttagtttaatgatagataacaaagaacaagaacttactgatagactattaaaagctaagcaatttgtatttggaaagcatactggtctcttactattggatgacacgattttagagaaatattcgctatcaaaaagcagcattggtaacagcaacaattgcaagccagtgccgaattcacatttatcattgttggcgattgttgattcgtggtttcaacttggtattgatccatatgatcatatgatttgttcgacgccattattcagaatattcctgggtgtgtccgaatatctttttttaaaacctggcttattagaacagacaattgatgcagctatccatgataaatcattcataaaagatgatttagaatttgttatttcggctagagaatggagctcggttgtttcttttgccaattttgatatatacaaaaagcaatttcagagtgttcaaaagttctttgagccaatgcttccagaggctaatctcattggcaacgagatgataaaaaccattctgagtcattctagtgaccgttcggccgctgaaaaaagaaatacataa

SEQ ID NO: 665 - DNA, 1005 bp, Saccharomyces cerevisiae
atggccagcaagactttgagggttctttttctgggtcccaaaggtacgtattcccatcaagctgcattacaacaatttcaatcaacatctgatgttgagtacctcccagcagcctctatcccccaatgttttaaccaattggagaacgacactagtatagattattcagtggtaccgttggaaaattccaccaatggacaagtagttttttcctatgatctcttgcgtgataggatgatcaaaaaagccctatccttacctgctccagcagatactaatagaattacaccagatatagaagttatagcggagcaatatgtacccattacccattgtctaatcagcccaatccaactaccaaatggtattgcatcccttggaaattttgaagaagtcataatacactcacatccgcaagtatggggccaggttgaatgttacttaaggtccatggcagaaaaatttccgcaggtcacctttataagattggattgttcttccacatctgaatcagtgaaccaatgcattcggtcatcaacggccgattgcgacaacattctgcatttagccattgctagtgaaacagctgcccaattgcataaggcgtacatcattgaacattcgataaatgataagctaggaaatacaacaagatttttagtattgaagagaagggagaacgcaggcgacaatgaagtagaagacactggattactacgggttaacctactcacctttactactcgtcaagatgaccctggttctttggtagatgttttgaacatactaaaaatccattcactcaacatgtgttctataaactctagaccattccatttggacgaacatgatagaaactggcgatatttatttttcattgaatattacaccgagaagaataccccaaagaataaagaaaaattctatgaagatatcagcgacaaaagtaaacagtggtgcctgtggggtacattccccagaaatgagagatattatcacaaataa

SEQ ID NO: 666 - DNA, 1003 bp, Saccharomyces cerevisiae
tcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaa

SEQ ID NO: 667 - DNA, 1542 bp, Saccharomyces cerevisiae
atgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatatgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaagtagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttga

SEQ ID NO: 668 - DNA, 1143 bp, Saccharomyces cerevisiae
atgtccgaggcgactttgctatcttacaccaagaaattattggcttctccgccgcaattgagtagcacagacctacacgatgcgttgctggttatattaagtcttttgcaaaaatgtgatacaaatagcgatgagagtctttccatctataccaaagtttcgagttttctcacggccttgagagttactaaacttgatcacaaggctgaatacattgcggaagctgcaaaggctgtgctcagacattccgaccttgttgatctacctttacccaagaaggacgaattacacccggaagatggaccagtaatcttagatattgtaggtactggtggtgacggacagaatacttttaatgtttccacgtctgctgctatcgttgcctccggaattcagggcctaaaaatttgtaagcacggtggtaaagcttctacatccaatagtggagctggtgacctaattggaactttaggctgtgacatgttcaaggttaattcatcgacagtgcccaaactttggcctgataatacgttcatgtttctacttgctcctttttttcatcatggaatgggccacgtttctaagatacgcaaatttcttggaattccgactgttttcaacgtactgggaccacttctacatccagttagccacgtaaacaagagaatattgggcgtttactcaaaggaacttgcgcctgaatatgccaaggcagccgctttggtatatccaggaagcgaaacttttatagtttggggacatgttgggttagacgaagtatcacctataggcaaaactactgtctggcatattgatccgacatcgtccgaacttaaattgaagaccttccaattagaaccttctatgtttggtttagaagaacacgagttgtcgaagtgtgcttcatacggccctaaagagaatgcgagaattctaaaagaagaagtcttgtccggcaagtaccaccttggcgacaataatcctatttatgactacatcttgatgaacaccgccgtgttatattgtttaagccaaggtcaccagaactggaaggaagggatcattaaggcagaagaaagcatacattctggtaatgcattacgttctttagaacactttatagatagtgtgagctccttgtag

SEQ ID NO: 669 - DNA, 675 bp, Saccharomyces cerevisiae
atgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatag

SEQ ID NO: 670 - DNA, 1455 bp, Saccharomyces cerevisiae
atgtctgtgcacgctgcaacaaacccaatcaataagcatgtggttctaattgacaactacgattcctttacctggaacgtttacgagtacttgtgccaggagggcgccaaagtgagcgtctaccgtaacgatgcaattacagttccagaaattgccgccttgaatcccgacacattgcttatctcgcctggaccaggccacccaaagacagattctggcatttcaagagactgtatccggtactttactgggaaaattcctgtatttggaatctgtatgggccagcaatgcatgtttgacgtatttggtggtgaagttgcctacgctggtgagattgtccacggtaaaacgtccccaatctctcacgacaactgtggaattttcaagaacgtgccgcaaggtattgctgtgacaagataccattcattggccgggacagaatcgtccctaccatcctgcttgaaggttactgcgagtaccgaaaatggaattatcatgggtgtaagacacaagaagtacactgtagaaggtgtgcaatttcatccggaatccatcttgaccgaggaaggtcatctgatgatcaggaacattttaaacgtcagtggaggcacttgggaggaaaacaaatcatctccttcaaattctattttggaccgtatctatgctcggcgtaaaatagacgtcaatgagcagtctaaaatcccaggtttcacctttcaagacttacaatctaactatgatttaggtcttgccccaccgttacaggatttctacacggtgttgtcatcatcccataaaagagccgttgttcttgctgaagtcaagcgtgcctctccatcgaagggacccatttgtttaaaagctgttgctgctgaacaggctctcaaatacgcagaggctggtgcatccgcaatttccgtattgaccgaacctcattggtttcacggttcgttacaggatttagtaaatgtgaggaaaatcctagatttgaaatttcctcccaaggagaggccttgtgttttgagaaaagaatttattttcagcaagtatcaaatactagaagcaagattagctggagctgacactgtccttcttatagtcaagatgctatctcaacccttattgaaggaactgtacagctacagtaaagatttgaacatggaacctctcgttgaggtgaactccaaagaggaattacaaagggctctagaaattggtgctaaagttgtaggtgtcaataatagggacctgcattcattcaacgtagacctaaataccaccagtaacttggtagaatctattccaaaggatgttcttctaattgctctatcgggaattaccaccagggacgatgctgaaaaatacaaaaaagaaggtgtccatggatttttagtgggtgaagccctaatgaaatcaaccgatgtgaagaagttcattcatgaattatgcgaataa

SEQ ID NO: 671 - DNA, 2124 bp, Saccharomyces cerevisiae
atgtcagaacaactcagacaaacatttgctaacgctaaaaaagaaaacaggaacgccttggtcacatttatgaccgcaggttacccaacagtcaaagacactgtccctattctcaagggtttccaggatggtggtgtagatatcatcgaattgggtatgcccttctctgatccaattgcagatggtcctacaattcaattatctaatactgtggctttgcaaaacggtgttaccttgcctcaaactctagaaatggtctcccaagctagaaatgaaggtgttaccgtacccataatcctaatgggttactataaccctattctaaactacggtgaagaaagatttattcaggacgctgccaaggctggtgctaatggttttatcatcgtcgatttgccaccagaggaggcgttgaaggtcagaaactacatcaatgataatggtttgagcctgatcccactagtggctccttctaccaccgacgaaagattggaattactatcgcatattgccgattcgtttgtctacgttgtgtctagaatgggtactactggtgttcaaagttctgtggccagtgatttggatgaactcatctctagagtcagaaagtacaccaaggatactcctttggccgttgggtttggtgtctctaccagagaacatttccaatcagttggtagtgttgctgacggtgtagtgattggttccaaaatcgtcacattatgtggagatgctccagagggcaaaaggtacgacgttgctaaggaatatgtacagggaattctaaatggtgctaagcataaggttctgtccaaggacgaattctttgcctttcaaaaagagtccttgaagtccgcaaacgttaagaaggaaatactggacgaatttgatgaaaatcacaagcacccaattagatttggggactttggtggtcagtatgtcccagaagctcttcatgcatgtctaagagagttggaaaagggttttgatgaagctgtcgccgatcccacattctgggaagacttcaaatccttgtattcttatattggccgtccttcttcactacacaaagctgagagattaactgagcattgtcaaggtgctcaaatctggttgaagagagaagatcttaaccacacgggatctcacaagatcaacaatgctttagcacaagttcttctagctaaaagattaggcaagaagaacgttattgctgaaaccggtgctggtcaacacggtgttgccactgccactgcatgtgctaaatttggcttaacctgtactgtgttcatgggtgcagaagatgttcgtcgccaagctttaaacgtcttcagaatgagaattctcggtgctaaagtaattgctgttactaatggtacaaagactctaagagacgctacttcagaggcattcagattttgggttactaacttgaaaactacttactacgtcgtcggttctgccattggtcctcacccatatccaactttggttagaactttccaaagtgtcattggtaaagaaaccaaggaacagtttgctgccatgaacaatggtaaattacctgacgcagttgttgcatgtgttgggggtggttccaactctacaggtatgttttcaccattcgagcatgatacttccgttaagttattgggtgtggaagccggtggtgatggtgtagatacaaagttccactctgctactctaactgccggtagacctggtgtcttccatggtgtcaagacttatgtcttgcaagatagtgatggtcaagtccatgatactcattctgtttctgctgggttagactacccaggtgtcggtccagaattggcatattggaaatctactggccgtgctcaattcattgcagctactgacgctcaggctctgcttggctttaaattattatctcaattagaaggtattattcccgctttggaatcttctcatgctgtttatggcgcttgcgaattggctaagacgatgaagcctgatcaacatttggttatcaatatttctggtagaggtgataaagatgtccaaagtgtcgctgaagtcttgccgaaattaggtccaaagataggttgggatttgagattcgaagaagacccatctgcctaa

SEQ ID NO: 672 - DNA, 1524 bp, Saccharomyces cerevisiae
atgaccgcttccatcaaaattcaaccggatattgactctctaaagcaattacagcagcaaaatgacgatagttccataaatatgtatcccgtgtatgcgtatttgccatcattggatctgactcctcacgtggcatatctaaaattggcacaattgaacaaccctgatagaaaggaatcatttctgttggaaagtgctaagacaaataatgaattagatcgttattcattcataggtatctcgccacgcaagaccatcaaaaccggtcctactgaaggcattgaaacagatcctttggaaattttggaaaaggagatgtctacctttaaagtagccgaaaatgttcctggtttaccgaaattaagtggtggtgctattggttatatttcttatgactgtgttcgttatttcgagccaaaaacaagaaggcctttgaaagatgtcctaagacttccagaggcatatttaatgctttgtgataccattattgcctttgataatgtttttcagagatttcaaatcattcataacattaataccaatgaaacttcgttggaggaaggttaccaagctgcagcacaaataatcactgatatcgtatcaaagctaaccgacgattcctcgccaataccatatccagaacaacctcctattaaattgaatcaaacttttgaatcgaatgtgggcaaggaaggttacgaaaatcacgtctccactttgaagaagcatattaagaaaggtgatattattcaaggtgtgccatcgcaaagagtggcaaggccaacttcgttacatcctttcaatatttacagacatttacgtacagtgaacccatctccttacctgttttatattgattgtttggatttccaaatcattggtgcatctccagaattgttgtgcaaatcggattccaaaaatagagtcattacccatccaattgctggtactgtcaaacgtggggctactactgaagaggatgatgctttagcggaccaattacgtggctcgttaaaagaccgtgcagaacatgttatgctggtagatttagcaagaaacgatattaacagaatttgtgacccattaacaacaagtgtcgataaactgttaactattcaaaaattttctcatgtccaacatctggtttctcaagtcagcggtgttctccgcccagaaaagacaagatttgatgcattcagatcgattttccctgcaggtactgtcagtggtgctccaaaggttagagccatggaattgattgccgaactagaaggagaaaggcgtggggtttatgcaggcgccgtaggtcattggtcatacgacggtaaaacaatggacaattgtatcgctttaaggactatggtctataaagatggcattgcttacttgcaagctggcggtggtattgtttacgattcagatgagtacgatgaatatgtcgaaaccatgaataaaatgatggccaatcacagtactattgtgcaagcagaagaattgtgggccgatatcgtaggatcagcttaa

SEQ ID NO: 673 - DNA, 1257 bp, Saccharomyces cerevisiae; identical to SEQ ID NO: 653

SEQ ID NO: 674 - DNA, 1356 bp, Saccharomyces cerevisiae; identical to SEQ ID NO: 654

SEQ ID NO: 675 - DNA, 6645 bp, Saccharomyces cerevisiae
atggccactattgctcccactgctccaatcacccctccaatggaatctacgggtgaccgtctggttacgttggaacttaaggacggcacggtcttacaaggttattcatttggtgctgagaaatccgtcgctggtgaattagttttccaaactggtatggttggttatcctgaatctgtgaccgatccatcttatgaaggccagatcttagtcatcacttacccattggtaggcaattatggtgtcccagatatgcacttgagagatgaattggtcgaagaattgccaagatattttgaaagtaatagaatccatattgccggtttagttatttctcactataccgacgagtactctcattatcttcgtaaatcttccttaggtaaatggttacaaaatgaagggatcccagctgtttatggtgttgatacaagatcattgaccaagcatttgagagatgcaggttcaatgttgggtaggttgtctttggaaaaaagcggctctgacagaaccatctccagatcttcctcttggagaagtgcgtttgatgttcctgaatgggtggatccaaatgttcaaaacctagtttctaaggtctccatcaatgaacctaaattgtacgttcctccagcagacaataagcacatcgaattgcaaaccggacccgatggtaaagttttaaggattctagccattgacgtgggtatgaaatacaatcaaattcgttgttttatcaaaaggggtgtagaattgaaagttgttccatggaactacgatttcactaaagaagattatgatggtctgtttatttcaaatggtccaggtgatccatctgttctagatgatctatctcaaagattgtcaaatgtcctggaggctaaaaagacgccagtattcggtatttgtctcggtcatcaattgatagcaagagctgccggtgcatccaccctaaaactaaaatttggtaaccgtggtcataacataccttgtacatcaactataagtggtcgttgttacataacatctcaaaaccatgggttcgctgtggatgttgacactctaacttccggatggaagccattgtttgttaacgcgaatgatgactctaacgaaggtatctatcattctgaattaccttatttttccgtccaattccatccagaatccacacctggcccaagagatacagaattcttgtttgacgtttttatccaagcagttaaagaattcaagtatacacaagtgttgaaaccaatcgctttcccaggtggcctattagaggataacgttaaggcacaccctagaatcgaagcgaagaaggttctagttctcggttctggtggtttgtccatcggtcaagctggtgaatttgactactctggttctcaagccatcaaagctttgaaagaagaaggtatctatacaattttaattaatccaaacattgctaccatccaaacttcgaaagggttggctgataaggtttattttgttcctgttactgcagagttcgtgagaaaagttattttacatgaaaggccggacgccatttatgtgacatttggtggacaaactgctttatctgttggtatagccatgaaagatgaatttgaggcgttaggagttaaagtattgggtactccaatcgatactattattaccacggaagaccgtgaactcttcagtaatgccattgacgaaattaatgaaaaatgtgcgaaatctcaagctgctaattcagtggacgaggcattggccgctgtcaaggagatcggtttcccagttattgtacgtgctgcatatgcattgggaggtttaggttccggtttcgctaataatgaaaaagaattggttgatctatgtaatgttgcattttcatcctcacctcaagttttagtcgagaaatctatgaaaggttggaaagaagtcgaatatgaagttgttcgtgatgcttttgacaactgtattactgtttgtaatatggaaaattttgatccactaggtattcacaccggtgattccatcgttgtagccccatctcaaactttatctgatgaagattacaatatgttaagaactactgctgttaatgttattagacacttaggtgttgttggtgaatgtaatatccaatatgctttaaatcccgtttctaaggattattgcatcattgaagttaatgcgcgtttgtcacgttcctctgctttagcttctaaggctactggttacccattggcctacactgcggctaagttaggtttgaatatcccattaaatgaagttaagaattccgtcacaaaatccacatgtgcttgttttgaaccttctctagactactgtgttgtcaaaatgccaagatgggatttgaagaagttcaccagagtttctaccgaattatcttcatcaatgaaatctgttggtgaagttatgagcatcggtagaaccttcgaagaagctattcaaaaagctatcagatccacagaatatgctaacctcggattcaatgagacagatctagatatcgacattgattacgagttgaacaaccctacggatatgcgtgtcttcgccattgcaaatgcttttgctaagaagggatattctgttgataaagtctgggaaatgactagaattgataagtggtttttaaacaaactgcacgatttggtccaatttgctgagaaaattagttcatttggtactaaagaggaattaccttccttagttttaagacaggctaagcagttaggttttgatgacagacagattgcaagatttttggattccaacgaagttgccatccgtagattaagaaaagaatatggaattacaccatttgtcaaacaaattgatacagttgccgctgaattccccgcttacacgaactatttatacatgacatacaatgctgactcacacgatttatcctttgatgaccacggtgttatggtcttgggttctggtgtttaccgtatcggttcttctgtcgaatttgattggtgtgctgttactgcagttagaacattacgtgccaacaatatcaaaactatcatggtcaactataatccagaaactgtttccacagattatgatgaggctgatagactatactttgaaaccatcaaccttgaaagagttttggatatttacgagattgaaaactcaagcggtgttgtcgtatcaatgggtggtcaaacttccaacaacatcgccatgactttacatcgtgaaaatgtaaagattcttggtacatcccctgacatgattgattctgctgaaaaccgttacaagttctctcgtatgttggatcaaattggtgttgaccaaccagcttggaaagaattgacatccatggacgaagctgaatcttttgccgaaaaggtgggttatccagttttggtacgtccatcttatgtgttatccggtgccgccatgaatactgtttattctaaaaacgatttggaatcctacttaaaccaagccgtcgaagtttcacgtgattatcctgttgttatcactaaatatattgaaaacgcaaaggagattgaaatggatgcagttgcaagaaatggtgaattggttatgcatgttgtctctgagcatgttgaaaatgcaggtgtccactcgggtgatgcaacattaatcgttccacctcaagatttggctcctgaaactgtggatagaattgttgtcgccactgctaaaattggtaaggctttgaaaattacaggtccatacaacatccaattcattgcaaaggacaatgaaatcaaggtcatagaatgtaatgttcgtgcttcgagatctttcccattcatttcaaaggttgttggcgtcaatctgattgaattggcaacaaaggccataatgggtttgcctttgacgccttatcctgttgaaaaattaccagatgattatgtcgccgttaaagtaccacaattctctttcccacgtttagcaggagctgatccagtcttaggtgttgaaatggcctctactggtgaagtcgctacttttggccactcgaagtatgaagcatacttaaagtctttgttggcaaccggcttcaaacttccaaagaagaatattttattgtctattggttcttacaaggaaaaacaagaattgctttcttccgtacaaaaactatacaacatgggatataaattatttgcaacatcaggtactgctgactttttatctgaacatggtattgccgtccaatatctggaggttttaaacaaggatgatgatgatcaaaaatcagaatactcacttactcaacatttggctaataatgaaattgacctttacatcaacttgccttctgccaacaggttccgtcgtcctgcatcctatgtttcaaaggggtataaaacacgtcgtttggctgtcgattattcggttccgttggttactaacgttaaatgtgcaaaattgttgattgaagccatttcaagaaatatcactttagatgtttctgaacgtgatgcacaaacttcccacagaactattaccttacctggtttaatcaatatcgcaacttatgttccgaatgcatcccatgttatcaaaggcccagctgaactgaaggagaccacacgtctatttttggaatccggttttacatactgtcaattgatgcccagatccatcagcggacctgttattactgacgttgcatccttgaaggccgcaaactctgtttcccaagattcatcttacactgacttttctttcactattgctggtacagcacacaatgctcatagtgttacgcaatctgctagcaaagtgacagcattgtttttgcccctacgtgaattaaagaacaagatcacagcagtagctgaacttctgaatcagtggccaactgaaaagcaagtgattgcagaagctaaaactgcagatttggcatcggttttattgttaacctcccttcaaaacagatctattcacattactggtgtttcgaataaggaagatttagctttgatcatgacggtcaaggcaaaagaccctagagtgacttgtgatgtcaatatttattctttgtttattgcccaagatgactatccggaggcagttttcttgcctactaaggaagatcaagagtttttctggaacaaccttgatagtatcgatgctttctctgtcggtgctcttcctgtcgccttggcaaatgtcacaggtaacaaggttgatgttggtatgggtatcaaagattcattaccactattgttggctgctgttgaagaaggtaaattaaccattgatgatatcgtccttcgtctgcatgacaatcccgctaaaattttcaacatccctactcaggactcagttgtcgaaattgatttggattattctttcagacgtaataagagatggtcaccattcaacaaagatatgaacggtggtattgagcgtgttgtctataatggcgaaacattagttttgagcggtgaattagtttcaccaggcgccaaaggaaaatgcattgttaatccaagtccagcttccataactgcttccgcagagctccaatctactagtgctaaaagaaggttctcgatcacggaagaagcaatcgctgataatttagatgccgcggaggatgcaattccagaacagcctttggaacaaaaattgatgtcttcaaggccaccaagagaacttgttgctccaggcgccatccagaatttgatccgtagtaacaatccattccgcggaagacatatattgtctatcaaacaattcaaacgttctgatttccatgtgttgtttgctgttgcacaagaactaagggcagctgtcgcaagagaaggtgtcttagatttaatgaaaggccacgttattactacaattttctttgaaccatctactcgtacttgttcttcattcattgctgctatggaacgtttgggtggtagaattgtaaatgttaatccattggtgtcttctgtcaagaaaggtgaaacccttcaagatactatcagaactttggcttgttacagtgatgccattgtcatgcgtcattcagaagaaatgtctgttcatatcgccgctaaatattctcctgttccaattattaatggtggtaatggttctcgcgagcatcctacgcaggccttcttggatttgtttacgattcgtgaagaaatcggtactgttaatggtattactgttactttcatgggtgatctcaaacatggtagaaccgtacattcattgtgtcgtttgttaatgcactatcaagtcagaattaatcttgtttctcctccggaattgaggttaccagaaggattaagagaagagctaagaaaagctggcttacttggtgttgagagcattgaattaacccctcatatcatctcaaagaccgatgttctgtattgtacaagggtccaagaagaaagattcaatagccctgaagaatatgcacgtctgaaggatacttatatcgtggacaacaagatcttggcacacgccaaagaaaatatggctatcatgcatccattgcctcgtgtaaatgaaatcaaagaggaagtggactacgatcatcgtgctgcttacttcagacaaatgaagtatggtttgttcgtcagaatggctttgttggccatggtcatgggtgttgatatgtga

SEQ ID NO: 676 - DNA, 1584 bp, Saccharomyces cerevisiae
atgccaatggatttccaacctacatcaagtcattcgaactgggtcgtgcaaaagttcggtggtacatctgtcggtaaatttcccgtccaaatagtggatgacattgtgaagcactattctaaacctgacggcccaaacaataatgtcgctgtcgtttgttccgcccgttcttcatacaccaaggctgaaggtaccacttctcgtcttttgaaatgttgtgatttggcttcgcaagaatctgaatttcaagacattatcgaagttatcagacaagaccatatcgataatgccgaccgcttcattctcaatcctgccttgcaagccaagttagtggatgataccaataaagaacttgaactggtcaagaaatatttaaatgcttcaaaagttttgggtgaagtgagttcacgtacagtagatctggtgatgtcatgtggtgagaagttgagttgtttgttcatgactgctttatgtaatgaccgtggctgtaaggccaaatatgtggatttgagccacattgttccctctgatttcagtgccagcgctttggataacagtttctacactttcctggttcaagcattgaaagaaaaattggccccctttgtaagtgctaaagagcgtatcgttccagtctttacagggttttttggtttagttccaactggtcttctgaatggtgttggtcgtggctataccgatttatgtgccgctttgatagcagttgctgtaaatgctgatgaactacaagtttggaaggaagttgatggtatatttactgctgatcctcgtaaggttcctgaagcacgtttgctagacagtgttactccagaagaagcttctgaattaacatattatggttccgaagttatacatccttttacgatggaacaagttattagggctaagattcctattagaatcaagaatgttcaaaatccattaggtaacggtaccattatctacccagataatgtagcaaagaagggtgaatctactccaccacatcctcctgagaacttatcctcatctttctatgaaaagagaaagagaggtgccactgctatcaccaccaaaaatgacattttcgtcatcaacattcattccaataagaaaaccctatcccatggtttcctagctcaaatatttaccatcctggataagtacaagttagtcgtagatttaatatctacttctgaagttcatgtttcgatggctttgcccattccagatgcagactcattaaaatctctgagacaagctgaggaaaaattgagaattttaggttctgttgatatcacaaagaagttgtctattgtttcattagttggtaaacatatgaaacaatacatcggcattgctggtaccatgtttactactcttgctgaagaaggcatcaacattgaaatgatttctcaaggggcaaatgaaataaacatatcctgcgttatcaatgaatctgactccataaaagcgctacaatgtattcatgccaagttactaagtgagcggacaaatacttcaaaccaatttgaacatgccattgatgaacgtttagaacaattgaaaagacttggaatttaa

SEQ ID NO: 677 - DNA, 1098 bp, Saccharomyces cerevisiae
atggctggaaagaaaattgctggtgttttgggtgctactggttccgttggtcaacgtttcattctgttgttggcaaatcaccctcatttcgaactgaaagttcttggtgcctcttctagatcagctggcaagaaatacgttgacgctgtgaactggaagcaaaccgatttgctaccggaatctgctaccgatattattgtttccgaatgtaaatctgaattctttaaagagtgtgacatcgtcttttccggattggatgctgactatgctggcgctatcgaaaaggaattcatggaagctggtatcgccattgtttccaatgccaagaattatagaagagaacaagatgtgccattgattgttcctgttgtcaatcctgagcatttggatattgtagctcaaaagcttgacaccgccaaggctcaaggtaagccaagaccagggttcattatctgtatttccaattgttccactgcaggtttggttgcaccattgaagcctttgattgaaaaattcggtcctattgatgctttgaccactactactttgcaagcaatctcaggtgctggtttctccccaggtgtaccaggtattgatattctagacaatattattccatacattggtggtgaagaagacaagatggaatgggagaccaagaaaatcttggctccattagcagaagacaagacacacgtcaaactattgactccagaagaaatcaaagtctctgctcaatgtaacagagtcgctgtttccgatgggcacaccgaatgtatctctttgaggttcaagaacagacctgctccatccgtcgagcaagtcaagacatgcctaaaagaatacgtctgcgatgcctacaaattaggctgtcattctgctccaaagcaaactattcatgttttggaacaaccagacagacctcaaccaaggttggacaggaacagagacagcggttacggtgtttccgttggtagaatcagagaagacccattgttagatttcaaaatggttgtcctttcccacaacaccattattggtgccgctggttctggtgtcttgattgccgaaatcttactagcaagaaacttgatttaa

SEQ ID NO: 678 - DNA, 1080 bp, Saccharomyces cerevisiae
atgagcactaaagttgttaatgttgccgttatcggtgccggtgttgttggttcagctttcttggatcaattgttagccatgaagtctaccattacttacaatctagttcttttggctgaagctgagcgttctttaatctccaaggacttttctccattaaatgttggttctgattggaaggctgctttagcagcctccactactaaaacgttgcctttggatgatttaattgctcatttgaagacttcacctaagccagtcattttggttgataacacttccagcgcttacattgctggtttttacactaagtttgtcgaaaatggtatttccattgctactccaaacaagaaggccttttcctctgatttggctacctggaaggctcttttctcaaataagccaactaacggttttgtctatcatgaagctaccgtcggtgctggtttgcctatcatcagtttcttaagagaaattattcaaaccggtgacgaagttgaaaaaattgaaggtatcttctctggtactctatcttatattttcaacgagttctccactagtcaagctaacgacgtcaaattctctgatgttgtcaaagttgctaaaaaattgggttatactgaaccagatccaagagatgatttgaatgggttggatgttgctagaaaggttaccattgttggtaggatatctggtgtggaagttgaatctccaacttccttccctgtccagtctttgattccaaaaccattggaatctgtcaagtctgctgatgaattcttggaaaaattatctgattacgataaagatttgactcaattgaagaaggaagctgccactgaaaataaggtattgagattcattggtaaagtcgatgttgccaccaaatctgtgtctgtaggaattgaaaagtacgattactcacacccattcgcatcattgaagggatcagataacgttatttccatcaagactaagcgttacaccaatcctgttgtcattcaaggtgccggtgccggtgctgccgttactgccgctggtgttttgggtgatgttatcaagattgctcaaagactttag

SEQ ID NO: 679 - DNA, 1461 bp, Saccharomyces cerevisiae
atgtcgcatactttaaaatcgaaaacgctccaagagctggacattgaggagattaaggaaactaacccattgctcaaactagttcaagggcagaggattgttcaagttccggaactagtgcttgagtctggcgtggtcataaataatttccctattgcttataagacgtggggtacactgaatgaagctggtgataatgttctggtaatttgtcatgccttgactgggtccgcagatgttgctgactggtggggccctcttctgggtaacgacttagcattcgacccatcaaggttttttatcatatgtttaaactctatgggctctccatatgggtctttttcgccattaacgataaatgaggagacgggcgttagatatggacccgaattcccattatgtactgtgcgcgatgacgttagagctcacagaattgttctggattctctgggagtaaagtcaatagcctgtgttattggtggctctatgggggggatgctgagtttggaatgggctgccatgtatggtaaggaatatgtgaagaatatggttgctctggcgacatcagcaagacattctgcctggtgcatatcgtggtctgaggctcaaagacaatcgatttactcagatcccaactacttggacgggtactatccggtagaggagcaacctgtggccggactatcggctgcacgtatgtctgcattgttgacgtacaggacaagaaacagtttcgagaacaaattctccagaagatctccttcaatagcacaacaacaaaaagctcaaagggaggagacacgcaaaccatctactgtcagcgaacactccctacaaatccacaatgatgggtataaaacaaaagccagcactgccatcgctggcatttctgggcaaaaaggtcaaagcgtggtgtccaccgcatcttcttcggattcattgaattcttcaacatcgatgacttcggtaagttctgtaacgggtgaagtgaaggacataaagcctgcgcagacgtatttttctgcacaaagttacttgaggtaccagggcacaaagttcatcaataggttcgacgccaattgttacattgccatcacacgtaaactggatacgcacgatttggcaagagacagagtagatgacatcactgaggtcctttctaccatccaacaaccatccctgatcatcggtatccaatctgatggactgttcacatattcagaacaagaatttttggctgagcacataccgaagtcgcaattagaaaaaattgaatctcccgaaggccacgatgccttcctattggagtttaagctgataaacaaactgatagtacaatttttaaaaaccaactgcaaggccattaccgatgccgctccaagagcttggggaggtgacgttggtaacgatgaaacgaagacgtctgtctttggtgaggccgaagaagttaccaactggtag

SEQ ID NO: 680 - DNA, 1335 bp, Saccharomyces cerevisiae
atgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatga

SEQ ID NO: 681 - DNA, 1920 bp, Saccharomyces cerevisiae
atgatatctagaaccattggtgaatctattccgcccaacacaaaacatgctgtttccgtgtgtttgcccacatgggaagctacagtaggctatgaagagggtgaaagcagtataattaactcgcttactaccggatatccaagatttttcatacacaagtcaataaagaaattatgtgaaattttatccgctaagtactccatggaagatgaagcttgtctttgcttcccctcttacaaggttgccaataggtgcagagagtttatcaaagtgaaaacgggtctttctaccaaagtacgcatcttacaactatgtacacctaaacctatgaaccaagaggaaaagctctggagaagggaatgtaaaatcacggtggtgtttgtagaccaggaaatattccccgtgatgaagcagtattggcaacattctggtgagattgtatctagcagaatggcggagtatattttacatgaattacaagtcaaggataatcttaagaagatggaaacagtggataacggtaaaaaatttatgaccgaagatgaaaacagagtgaacgaagaatatatagaaacgagatttgggagaaatttaaattttcttgctgctgataaagccaaatatctaatacgaaagaggattgccacaaaagttgttgaaaaaattgactctgaaggtctatcggacctattctcttttgaacactataacgagagcaacggtccattcaatgttggcagtggagaggctctggatgatgatcagttgaattcggacatacctgccgaaacaattacttctatgggagaaagtggctcaaacagtacttttgaaaacacagctaccgatgacttgaagtttcatgtcaaccctaatacggatgtttacttatttccaagtggaatggcgtccattttcactgcccacaggctgcttttaaacttcgatgccaagcgcttatcaaggtcttctagtagacaagataagttgattggatatggacctccgttcaagaagaccgtcatgtttggattcccatatacagatactctgagcattcttcggaagttcaatcacacacatttcttgggacagggagattcaacgtcaatgaacgctctgaaaaatattttacattctggtgagcaaatactggcggtatttatagaagctccatcgaacccactgttgaaaatgggagatttacaagaactgaaaaggctatcagacttgtattcattttacatagtggtcgatgaaactgtgggtggctttgtcaatatagatgtattaccgtatgccgatattgtttgtagttcgctaacgaaaatcttcagcggcgactcgaacgttattgcaggatccttagtactaaatcctagaggaaagatttatgagtttgctagaaaatttatgaagactgaagacggatatgaagattgcctatggtgcgaagatgcgttatgcctggaaagaaattcgagagacttcgtggaacgtacaatcaaggtgaatacaaacactgatatattgttaaaaagggtgttattgcctcaggtgggaaaattgttcaagaaaatatattaccccagtttaacatcagaggataccaagcggaattatgacagcgttatgtctacaaaagatggtgggtatggaggtttattttcactaacttttttcaatattgaagaggcaaagaagtttttcaataatctggaattgtgcaaaggaccttctctcggtacgaatttcactttggcgtgtccatatgctattattgcccactaccaggaattagacgaggtagctcaatatggtgtcgaaacaaatcttgtaagagtgagcgtcggtttggaaaatagcgacgttttatgcaatgtttttcagcgtgccattgagaaagctttaggggaataa

SEQ ID NO: 682 - DNA, 1074 bp, Saccharomyces cerevisiae
atggttcgtgccttcaaaattaaagttccagcttcttccgccaatatcggccctggttatgatgttcttggtgtcggtctttctctattcttggagttagatgtcaccatcgactccagccaagctcaggaaacaaacgacgatcccaacaactgcaagctgtcttacactaaagaaagtgaaggctattctacggtcccattgcgttctgatgctaacctgattaccaggactgcgttatatgtgttgcgttgcaacaatattagaaacttcccctccggaaccaaagttcacgtctccaacccaatcccacttggccgtggattgggttcctctggtgcagcagttgtggcaggtgttattttaggtaacgaagtggcccaattgggtttctctaagcaacgtatgttggactactgtttgatgattgaacgtcatccagacaacataaccgctgctatgatgggaggcttttgcggttcattcctaagggacttgaccccacaagaggtggaaagacgtgagattccattggctgaggtgcttccagaaccttctggtggtgaagataccggtctggttcccccattacctcccaccgatatcggtagacatgtcaaataccaatggaaccccgccattaaatgtattgcgatcatcccacagttcgagttgtccaccgccgactccagaggcgttcttccaaaagcctacccaacccaggacttggttttcaatctacaaagattggccgtcttgaccacagctttgaccatggacccacctaatgccgacttaatctaccctgctatgcaagatcgtgtccaccaaccttatagaaagacattgatcccaggtctcacggaaatcttatcatgtgtcaccccatccacataccctggcctattgggtatctgcttgtcaggtgcaggcccaactatcttggctttggccactgagaatttcgaagaaatctctcaagaaattatcaacaggttcgccaaaaacggcatcaagtgctcctggaaactactggagcctgcctacgatggtgctagcgtcgaacagcaatga

SEQ ID NO: 683 - DNA, 1545 bp, Saccharomyces cerevisiae
atgcctaacgcttcccaagtttacagatctaccagatccagctctccaaagacaatctcttttgaagaggctatcattcaaggtctggccactgacggtggtcttttcattccaccaactattccacaagtggaccaagccactcttttcaatgattggtcaaagctctccttccaagacttagcctttgctatcatgagactatacattgcccaagaagagattccagatgctgatctaaaggacttgatcaagagatcttattctactttccgttctgatgaagtcacccccttggtgcaaaacgtcactggtgacaaggagaatttgcacattttagaattattccacggtcctacctacgctttcaaagacgttgctttacaatttgtcggtaatctttttgaatacttcttacaaagaaccaacgccaatttacctgaaggcgagaaaaagcaaatcactgtggtcggtgctacttccggtgacactggttctgcagccatctacggtttaagaggcaaaaaggacgtttccgttttcatcttatatccaaccggtagaatttccccaattcaagaagaacaaatgaccaccgttccagatgaaaacgtccagactttgtctgttaccggtactttcgacaactgtcaagatatcgtcaaagctattttcggtgacaaagaattcaactctaaacacaacgtcggtgctgttaactccatcaactgggcaagaatcttggcccaaatgacctattacttttattcattcttccaagccaccaacggtaaggactccaagaaggtcaagttcgttgtgccaagtgggaacttcggtgatatattggccggttattttgccaagaaaatgggtttgcctattgaaaaactggccatcgctaccaatgaaaacgacattttggacagatttttgaaatctggtctatacgaaagatcagacaaggttgctgctactttatccccagcaatggatatcttaatctcttctaactttgaaagactactatggtacctagctcgtgaatacctagctaatggtgatgatttgaaagccggtgaaatcgtcaacaattggttccaggaattgaagaccaacggtaagttccaagttgacaaatccatcattgaaggcgcatcaaaggactttacatcagaaagagtttccaatgaagaaacatctgaaacaatcaagaagatctacgaatcatctgtaaatccaaaacattacatcttagatcctcacacagctgtcggtgtttgcgccacagaaagattgattgcaaaagataatgacaagtccatccaatacatttctctatctaccgctcacccagctaaatttgccgatgctgtaaacaatgcattgtctggattttccaattattcatttgaaaaggatgttttgcctgaggaattgaagaaactatccacattaaagaagaaattaaaattcatcgaaagagctgacgttgaattggtcaaaaacgctattgaagaagaacttgctaaaatgaaattataa

SEQ ID NO: 684 - DNA, 1731 bp, Saccharomyces cerevisiae
atgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgtcactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaa

SEQ ID NO: 685 - DNA, 1185 bp, Saccharomyces cerevisiae
atgactctacaagaatctgataaatttgctaccaaggccattcatgccggtgaacatgtggacgttcacggttccgtgatcgaacccatttctttgtccaccactttcaaacaatcttctccagctaaccctatcggtacttacgaatactccagatctcaaaatcctaacagagagaacttggaaagagcagttgccgctttagagaacgctcaatacgggttggctttctcctctggttctgccaccaccgccacaatcttgcaatcgcttcctcagggctcccatgcggtctctatcggtgatgtgtacggtggtacccacagatacttcaccaaagtcgccaacgctcacggtgtggaaacctccttcactaacgatttgttgaacgatctacctcaattgataaaggaaaacaccaaattggtctggatcgaaaccccaaccaacccaactttgaaggtcaccgacatccaaaaggtggcagaccttatcaagaagcacgctgccggccaagacgtgatcttggttgtcgacaacaccttcttgtccccatatatctccaatccattgaacttcggtgcagacatcgttgtccactccgctacaaagtacatcaacggtcactcagacgttgtgctcggtgtcctggccactaataacaagccattgtacgagcgtctgcagttcttacaaaacgccattggtgctatcccatctcctttcgatgcttggttgacccacagaggtttgaagactttgcatctacgtgtcagacaagctgccctcagcgccaacaaaatcgctgaattcttggcagcagacaaggaaaacgttgtcgcagtcaactacccaggtttgaagacacaccctaactacgacgtagtgttaaagcaacaccgtgatgcccttggtggtggtatgatctccttcagaatcaagggtggtgctgaagctgcttccaagttcgcctcctccacaagactgttcacattggccgaatcccttggtggtatcgaatctctattggaagtgcccgctgtgatgacccacggtggtatcccaaaggaggccagagaggcctctggtgtttttgacgacttggttagaatctctgtcggtattgaagacactgacgatcttttggaagacatcaagcaagccttgaaacaagccaccaactaa

SEQ ID NO: 686 - DNA, 1524 bp, Saccharomyces cerevisiae
atgactaaatctgagcagcaagccgattcaagacataacgttatcgacttagttggtaacaccccattgatcgcactgaaaaaattgcctaaggctttgggtatcaaaccacaaatttatgctaagctggaactatacaatccaggtggttccatcaaagacagaattgccaagtctatggtggaagaagctgaagcttccggtagaattcatccttccagatctactctgatcgaacctacttctggtaacaccggtatcggtctagctttaatcggcgccatcaaaggttacagaactatcatcaccttgccggaaaaaatgtctaacgagaaagtttctgtcctaaaggctctgggtgctgaaatcatcagaactccaactgctgctgcctgggattctccagaatcacatattggtgttgctaagaagttggaaaaagagattcctggtgctgttatacttgaccaatataacaatatgatgaacccagaagctcattactttggtactggtcgcgaaatccaaagacagctagaagacttgaatttatttgataatctacgcgctgttgttgctggtgctggtactggtgggactattagcggtatttccaagtacttgaaagaacagaatgataagatccaaatcgttggtgctgacccattcggttcaattttagcccaacctgaaaacttgaataagactgatatcactgactacaaagttgagggtattggttatgattttgttcctcaggttttggacagaaaattaattgatgtttggtataagacagacgacaagccttctttcaaatacgccagacaattgatttctaacgaaggtgtcttggtgggtggttcttccggttctgccttcactgcggttgtgaaatactgtgaagaccaccctgaactgactgaagatgatgtcattgttgccatattcccagattccatcaggtcgtacctaaccaaattcgtcgatgacgaatggttgaaaaagaacaatttgtgggatgatgacgtgttggcccgttttgactcttcaaagctggaggcttcgacgacaaaatacgctgatgtgtttggtaacgctactgtaaaggatcttcacttgaaaccggttgtttccgttaaggaaaccgctaaggtcactgatgttatcaagatattaaaagacaatggctttgaccaattgcctgtgttgactgaagacggcaagttgtctggtttagttactctctctgagcttctaagaaaactatcaatcaataattcaaacaacgacaacactataaagggtaaatacttggacttcaagaaattaaacaatttcaatgatgtttcctcttacaacgaaaataaatccggtaagaagaagtttattaaattcgatgaaaactcaaagctatctgacttgaatcgtttctttgaaaaaaactcatctgccgttatcactgatggcttgaaaccaatccatatcgttactaagatggatttactgagctacttagcataa

SEQ ID NO: 687 - DNA, 1398 bp, Saccharomyces cerevisiae
atgccgatcaagagattagatacagttgtggtaaataccggctctcaaaatgaccaacattcagcctccgtgccaccggtgtatttgtcgactaccttcaaagtggacttgaataatgaagatgcacagaactacgattattccagatcgggaaacccgaccagaagtgtccttcaacaccagattggtaagctttatcgtgtcccacaggaaaacgtattagctgtgagcagtggtatgacggcgctagacgtcatcctgcgtgggctcgtcttacttaacggcactgacaaccatacgccaacaataatagccggcgatgatctttatggaggcacccaaaggctgctgaattttttcaagcaacagagtcatgcagtctctgttcatgtggacacttccgattttgaaaagttcaaaaccgttttccagtctttagataaagttgattgtgttcttctagagtctccgaccaatccgctttgcaaggttgtagatatccctagaatattacgttttgtgaaatgcatatctcccgacactacagttgtcgttgataatactatgatgagtggactcaattgtaatcctcttcaactgaatccaggctgcgatgtcgtatacgaatctgctaccaagtacttgaatggtcatcacgatttgatggggggtgttattatcagcaaaacaccagaaatagcctcgaagctttactttgtcattaattctacaggagctggattatccccaatggattcttggctacttgtgaggggcctaaaaactctaggagttagattatatcaacagcagagaaatgctatgatattggctcattggctagaaaattcatgcggattcaaacctaccagaacaaacaaggctacgaaaactagatttgttggattacgctccaacccggatttcaagctgcataaatcgttcaataatggcccaggtgccgtgttatccttcgaaacggggtccttcgaacattcaaagagactggtcagttccaaaaaactgagtatatgggctgtgacggtatctttcgggtgtgtaaattcgcttctatctatgccttgcaaaatgtcccatgcttccattgatcccgaattaaggaaagagagagattttcctgaagatttggttcgtctttgctgcggtatcgaaaatatagtagatttgaagaaagatttattagcggcgatggttgacgctgatattatagaagtaagagaaaatggcaaatatcttttcaacaaattgaataagaacctagctgtgaacactaccatcgatgacctgcataagcctttaagtatttacgaagaattttacaatcaagatctcatcagaaaggactcagaattgaatattaagagttcgaaattgtaa

SEQ ID NO: 688 - DNA, 2304 bp, Saccharomyces cerevisiae
atggttcaatctgctgtcttagggttcccaagaatcggtccaaacagagaattaaagaaggccactgaaggttactggaacggtaaaatcactgtcgatgaattattcaaggtcggtaaggatttgagaactcaaaactggaagttgcaaaaggaggctggtgttgatatcatcccatccaatgacttctccttttacgaccaagttttggatttgtctttgttgttcaatgtcattccagaccgttacactaagtacgatctatctccaatcgacactttgtttgctatgggtagaggtttacaaagaaaggccactgaaactgaaaaggctgtcgacgtcactgctttggaaatggttaaatggttcgactctaactaccattacgttagaccaactttctccaagaccactcaatttaagttgaacggccaaaagccagttgacgaatttttggaagccaaggagttaggtattcatactagacctgtcttgttgggtccagtttcttacttattcttgggtaaggctgacaaggattctctagatttggaaccattgtccctattggaacaattgttgcctctatacactgaaatcctatctaaattggcttctgctggtgccactgaagttcaaattgacgaacctgtcttagttttggacttgcctgccaacgcccaagccgccattaagaaggcttacacttacttcggtgaacaaagcaatctaccaaagattactttggctacttacttcggtaccgttgtccctaacttagacgccatcaagggcttgccagttgctgccttacacgttgactttgttagagctccagaacaatttgatgaagtcgttgccgccattggtaacaaacaaaccttgtccgttggtattgttgatggtagaaacatttggaagaatgatttcaagaagtcttccgctatcgttaacaaggctattgaaaagttgggtgctgacagagtcgttgttgccacttcttcttctctattgcacacaccagttgatttgaacaacgaaaccaagttggacgctgaaatcaagggctttttctctttcgccactcaaaaattggatgaagttgttgtgatcaccaagaacgtttccggtcaagacgttgctgctgccctagaagctaacgctaaatctgttgaatccagaggtaaatccaagtttatccacgatgctgccgttaaggccagagttgcctctatcgacgaaaaaatgtctactagagcagctccatttgaacaaagattgcctgaacaacaaaaagtcttcaacttgccattgttcccaacaacaactattggttccttccctcaaaccaaggacatcagaattaacagaaacaaattcaacaagggcaccatctctgctgaagaatatgaaaaattcatcaattctgaaattgaaaaggtcatcagattccaagaagaaattggtttggatgtcttagtccacggtgaaccagaaagaaacgatatggttcaatacttcggtgaacaaatcaacggttatgctttcactgttaacggttgggttcaatcttacggttccagatatgtcagaccaccaattattgttggtgacttgtccagaccaaaggctatgtccgtcaaggaatctgtttacgctcaatccatcacttctaagccagtaaagggtatgttgactggtccaattacctgtttgagatggtctttcccaagagacgatgtcgaccaaaaaactcaagctatgcaattagctttggctttgagagatgaagtcaatgatttggaagctgccggtatcaaggttatccaagttgatgaaccagctttaagagaaggtttaccattgagagaaggtactgagagatctgcttactacacctgggctgccgaagctttcagagttgctacttctggtgttgctaacaagactcaaatacactctcatttctgttactctgacttggatccaaaccatatcaaggctttggatgctgatgttgtttccatcgaattctctaagaaggacgatgctaactacattgctgaattcaaaaactatccaaaccacattggtctaggtttattcgatattcattctccaagaattccatcaaaggatgaatttatcgccaagatttcaaccatcttgaagagctacccagctgaaaagttctgggttaacccagattgtggtttgaagactagaggctgggaagaaactagattgtctttgactcatatggtcgaagccgccaagtacttccgtgaacaatacaagaattaa

SEQ ID NO: 689 - DNA, 1149 bp, Saccharomyces cerevisiae
atggccggtacatttttattcacttctgaatccgttggtgaaggtcacccagataagatctgtgaccaagtttccgacgccatcttggacgcttgtttagccgaggaccctcactccaaagttgcgtgtgaaaccgcggcaaagactggtatgattatggtctttggtgaaattactaccaaggcacagttggattaccaaaaaatcgtcagagacaccatcaagaagattggttacgatgattccgccaagggtttcgactataagacctgtaacgtccttgtcgccattgagcaacaatctccagatatcgcccaaggtgtccacgaggagaaggatttggaagacatcggtgccggtgaccaaggtatcatgtttggttacgccacagatgaaactccagagggtttgcctttgactattcttttggctcataaactaaacatggccatggctgacgcgagaagagatggctctttagcgtggttgagaccagacaccaagactcaagtcaccgtcgaatacaaggatgaccacggtagatgggttccacaaagaatcgacaccgtcgtcgtctccgctcaacatgctgacgaaatcacgaccgaggacttaagagcgcaactaaagtccgagatcattgaaaaagtcatcccaagagacatgttggacgaaaacaccaaatactttatccaaccttccggtagattcgtcatcggtggtcctcaaggtgacgctggtttgaccggtagaaagatcatcgtcgacgcttacggtggtgcctcatccgtcggtggtggtgccttctccggtaaggactactctaaggttgatcgttctgccgcttatgccgctagatgggttgccaagtccctagttgccgctggtttatgtaagagagttcaagttcaattttcttatgccatcggtattgcggaaccattgtccttgcacgttgacacctatggtactgcgaccaagtctgacgaagaaattatcgacattatcagcaagaactttgacttgagacctggtgtattggtcaaggagttggacttagctagaccaatctacttgccaaccgcttcttatggccatttcacaaaccaagaatacccatgggaaaagcctaagactttgaagttctaa

SEQ ID NO: 690 - DNA, 1155 bp, Saccharomyces cerevisiae
atgtccaagagcaaaactttcttatttacctctgaatccgtcggtgaaggtcacccagacaagatttgtgaccaagtttctgatgctattttggacgcttgtttagaacaagatccattctccaaggttgcctgtgaaacagctgccaaaactggtatgattatggttttcggtgaaattaccaccaaagctagacttgactaccaacaaatagtaagagataccatcaagaagattggttatgacgattctgccaagggtttcgactacaagacatgtaatgttttagtagctatcgaacaacaatctccagatatcgctcaaggtctgcactatgaaaagagcttagaagacttaggtgctggtgaccaaggtataatgtttggttacgctacagacgaaactccagaagggttaccattgaccattcttttggctcacaaattgaacatggctatggcagatgctagaagagatggttctctcccatggttgagaccagacacaaagactcaagtcactgtcgaatacgaagacgacaatggtagatgggttccaaagaggatagataccgttgttatttctgctcaacatgctgatgaaatttccaccgctgacttgagaactcaacttcaaaaagatattgttgaaaaggtcataccaaaggatatgttagacgaaaataccaaatatttcatccaaccatccggtagattcgtcatcggtggtcctcaaggtgacgctggtttgaccggtagaaagattattgtcgacgcttacggtggtgcctcatccgtcggtggtggtgccttctccggtaaggactattccaaggtcgatcgttccgctgcttacgctgctagatgggttgccaagtctctagttgccgctggtttgtgtaagagagtccaagtccaattttcatatgctattggtattgctgaaccattgtctttacatgtggacacctatggtacagctacaaaatcagatgacgaaatcattgaaattattaagaagaacttcgacttgagaccaggtgtgttagtaaaggaattagatttggctagaccaatttacttaccaaccgcttcttatggtcacttcactaatcaagagtactcatgggaaaaaccaaagaaattggaattttaa

SEQ ID NO: 691 - DNA, 1410 bp, Saccharomyces cerevisiae
atgacaagcattgacattaacaacttacaaaatacctttcaacaagctatgaatatgagcggctccccaggcgctgtttgtacttcacctacgcaatctttcatgaataccgttccacagcgcttgaatgctgtaaagcacccaaaaattttgaagcctttctcaacgggtgatatgaagattttactattagaaaacgttaatcaaactgctattacaatcttcgaagagcaaggttaccaagtcgaattctataaatcttcattgcccgaggaagagttgatcgaaaagatcaaggacgttcatgctattggtatcagatcaaagactagattaacttcaaatgtcttacaacatgcgaagaatctggtttgtattggttgtttctgtatcggtaccaaccaagttgacttagactacgctaccagcagaggtattgctgttttcaactcgcctttctccaactcaagatcagtagcagaattggtcatcgctgaaatcattagtttagcaagacaactaggtgatagatctatcgaattacataccggtacatggaataaggttgctgctagatgttgggaggtaagaggaaaaactcttggtattattgggtacggtcacattggttcccaattatcagttcttgcagaagctatgggtttgcatgtgttgtactacgatattgtaactatcatggccttgggtactgccagacaagtttctacattagatgaattgttgaataaatctgattttgtgacactacatgtaccagctactcctgaaactgaaaaaatgttatctgccccacaatttgctgctatgaaggatggcgcttatgttattaatgcttcaagaggtactgtcgtggacattccatctttgatccaagccgtgaaagccaacaaaattgcaggtgctgctttggatgtttatccacatgaaccagctaagaacggtgaaggttcatttaacgatgagctaaatagctggacttctgaattagtttcattaccaaatatcatcttgacaccacacattggtggctctaccgaagaagcccaaagctcaatcggtattgaagtggctaccgcattgtccaaatacatcaatgaaggtaactctgtcggttcagtcaacttcccagaagtggcattgaaatcattgtcttacgaccaagagaacactgtgcgtgtgttatacattcaccaaaatgtaccaggtgttttgaagaccgtcaatgatattttatcgaaccataacatcgaaaagcaattttccgattcaaatggtgaaattgcttatttaatggctgatatctcttctgttgaccaaagcgatattaaagatatttatgaacaactaaatcaaacctctgctaagatctcaattagattgctatattaa

SEQ ID NO: 692 - DNA, 1188 bp, Saccharomyces cerevisiae
atgtctttggaaagagaggaaccacaacatttcggagcagggccagctcaaatgcctacaccagttttgcaacaagctgctaaagacttaatcaatttcaatgacataggtttgggtatcggtgaaatttctcaccgttcgaaggatgccaccaaagtgattgaagactctaagaagcacttaatcgaactgctaaatattcctgacactcatgaagtgttctacttgcaaggtggtggcactactggtttttcttccgttgctactaatttggcagctgcatatgtgggtaagcatgggaagattgcacctgccggttatttagtcaccggtagttggtctcagaaatcttttgaagaggcaaagagattgcacgttcctgctgaagttatcttcaacgctaaagattataacaatggcaaatttggtaaaattccggatgaatccctttgggaagataaaatcaaaggtaaggctttctcatacgtgtacctatgtgagaatgaaactgttcatggtgttgaatggccagaattaccaaaatgtttagtaaacgaccccaacatcgaaattgttgctgacttatccagcgacattttgtctcgtaagattgacgtttctcaatacggtgtcatcatggcaggcgcccaaaaaaacattggtttagcaggcttaaccctatacattatcaagaaatccatccttaagaatatttctggcgcttctgatgaaacattacatgaattgggagtaccaatcacccctattgcattcgactatccaacggtggtgaagaacaactcagcctataatacaattccaattttcactttacatgttatggatctcgtgttccaacatattttgaagaagggtggtgttgaagcgcaacaggctgaaaatgaagaaaaggccaagatattatatgaggcattggatgcaaattcagatttttacaacgttccagtggatccaaagtgtagatcaaaaatgaatgtcgttttcacccttaaaaaggacggccttgatgaccagtttctaaaagaggcagctgctcgtcatttaaccggtttgaaaggacatcgttcagttggtgggttcagagcctccatctataacgcgctttcagtgaaagctgtacaaaacttggtagattttatcaaggaatttgctgagaaaaacgcttaa

SEQ ID NO: 693 - DNA, 930 bp, Saccharomyces cerevisiae
atgtcaaagtttgttatcacctgcatagctcatggagaaaatctcccaaaagaaaccatcgaccagattgcgaaagaaattactgaaagctcggcgaaagatgtatcaatcaatggtaccaagaaactatcggccagagctaccgatatattcattgaagtcgcaggatcgattgttcaaaaagacctcaagaataagctgacgaacgtcattgacagtcataatgatgttgatgttattgtttctgtcgacaatgaatatcgtcaagccaaaaagctctttgtctttgacatggattcaacattaatctaccaagaggtcatcgaattgattgccgcttatgctggtgttgaagaacaagtgcacgagatcacagaaagagccatgaacaatgaacttgatttcaaagagtctttaagagaacgcgttaaattattgcaaggcctccaagtcgatacactatatgatgaaataaaacaaaagctagaggtcaccaagggtgtgccagaactatgcaagttccttcacaaaaaaaattgcaagctcgctgttttaagcggtggttttattcagtttgccggttttatcaaggatcagttaggtttagatttttgtaaggcaaacttgttggaagttgacactgatggaaaattaaccggtaaaacactgggtcctatcgtagacggacagtgcaagagtgaaacccttctgcaactatgtaatgactacaatgttccagttgaagcaagttgtatggtgggtgacggtggtaacgacctgccagccatggctaccgccgggtttgggatcgcatggaacgccaagccaaaggtgcagaaagctgcaccttgtaagttgaataccaagagcatgactgacattttatacattcttggttacaccgatgatgaaatatacaatagacaatga

SEQ ID NO: 694 - DNA, 1410 bp, Saccharomyces cerevisiae
atgccttacactctatccgacgctcatcataagttgatcacctctcatttggtggacaccgaccctgaagtggactccattatcaaggatgaaattgaaagacaaaagcactccatcgatttgattgcttctgaaaatttcacctcaacctccgttttcgatgcccttggaactccattgtccaacaaatactctgaaggttatccaggtgctcgttactacggtggtaatgaacacattgacagaatggaaattctatgtcaacaaagagctttgaaagctttccatgttactccagacaaatggggtgttaacgtccaaactttatctggttctcctgctaacttgcaggtttatcaagctattatgaagcctcatgaaagattgatgggtctatacctaccagatggtggtcatttgtctcacggttacgctactgaaaacagaaaaatttctgctgtttccacatacttcgaatctttcccatacagagttaacccagaaaccggtattatcgactacgatactttagaaaagaacgccatcctatatagaccaaaggttcttgttgctggtacttcagcatactgtcgtttaattgactacaagagaatgagagaaatcgccgacaaatgtggtgcttacttgatggtagacatggcccacatttctggtttgatcgccgcaggtgtcatcccatctcctttcgaatacgctgatatcgttaccaccaccactcacaagtctttgagaggtccacgtggtgctatgattttcttcagaagaggtgtgagatctatcaaccctaagaccggtaaggaagttctatacgacttggaaaacccaattaacttctctgttttcccaggtcaccaaggtggtccacacaaccataccattgctgctttggccactgctttgaagcaagctgccactccagaattcaaggaataccaaactcaagtcttgaagaatgctaaggctttggaaagtgaatttaagaacttgggctacagattagtttccaacggtaccgattctcacatggttctagtatccttgagagaaaagggtgttgatggtgctcgtgttgaatacatttgtgaaaagattaacattgctttgaacaaaaactctattccaggtgacaaatctgctttggttccaggtggtgtccgtattggggctccagccatgaccactagaggaatgggtgaagaagatttccacagaattgttcaatacattaacaaggctgtagaattcgctcaacaagttcaacaaagcttgccaaaggatgcttgtagattaaaggacttcaaagccaaggtcgacgaaggctctgatgttttgaacacctggaaaaaggaaatttacgactgggctggcgaatacccattggctgtgtaa

SEQ ID NO: 695 - protein, 1164 aa, Saccharomyces cerevisiae
ATGACTGAATTCGAATTGCCTCCAAAATATATCACCGCTGCTAACGACTTGCGGTCAGACACATTCACCACTCCAACTGCAGAGATGATGGAGGCCGCTTTAGAGGCCTCTATCGGTGACGCTGTCTACGGTGAAGATGTTGACACCGTTAGGCTCGAACAGACCGTTGCCCGCATGGCTGGCAAAGAAGCAGGTTTGTTCTGTGTCTCTGGGACTTTGTCCAACCAGATTGCCATCAGAACTCACTTGATGCAACCTCCATACTCTATTCTATGTGATTACAGGGCTCACGTTTACACTCACGAAGCCGCTGGACTGGCGATCTTGTCTCAAGCGATGGTGGTTCCTGTGGTTCCTTCCAACGGTGACTACTTGACCTTGGAAGACATCAAGTCACACTACGTCCCAGACGACGGTGATATTCACGGTGCCCCCACCAGATTGATTTCTCTGGAAAACACTTTACACGGTATTGTTTATCCATTGGAAGAACTGGTCCGCATCAAAGCTTGGTGTATGGAAAATGGTCTCAAACTACATTGTGACGGTGCCAGAATCTGGAATGCCGCTGCACAATCTGGCGTGCCATTAAAGCAATATGGGGAAATCTTCGACTCCATCTCCATCTGTCTATCCAAGTCTATGGGTGCTCCTATTGGGTCCGTCTTGGTTGGGAACCTTAAGTTTGTCAAGAAGGCCACCCATTTCAGAAAACAACAAGGTGGTGGTATTAGACAATCTGGTATGATGGCTAGAATGGCTCTTGTAAACATCAACAACGATTGGAAGTCCCAATTGCTGTACTCGCACTCTTTGGCTCATGAATTAGCCGAATATTGTGAGGCAAAGGGCATCCCGCTAGAGTCTCCAGCAGACACCAACTTTGTCTTTATTAACCTGAAGGCCGCTAGAATGGACCCAGATGTCCTTGTTAAGAAGGGTTTGAAGTACAACGTTAAGCTAATGGGTGGTAGAGTCTCGTTCCACTATCAAGTCACCAGAGATACTTTGGAAAAAGTCAAATTGGCCATCTCCGAGGCCTTCGACTATGCTAAAGAACATCCTTTCGACTGTAACGGACCTACCCAGATTTACCGTAGTGAATCCACCGAGGTCGACGTTGATGGCAACGCTATCCGCGAAATAAAAACCTACAAATACTGA

SEQ ID NO: 696 - DNA, 930 bp, Saccharomyces cerevisiae
atgctgagatcgttattgcaaagcggccaccgcagggtggttgcttcttcatgtgctaccatggtgcgttgcagttcctcgtcgacctccgcgttggcgtacaagcagatgcacagacacgcaacaagacctcccttgcccacactagacactccttcctggaatgccaacagtgccgtttcatccatcatttacgaaacaccagcgccttctcgtcaaccaagaaaacagcatgtcttgaactgtttggtgcaaaacgaacccggtgtcttgtccagagtctcgggtacgttagctgccagaggctttaacatcgattcgttggtcgtgtgcaacaccgaggtcaaagacctaagtagaatgaccattgttttgcaagggcaagatggcgtagtcgaacaagcacgcagacaaatcgaagacttggtccccgtctacgccgtcctagactataccaattctgagatcatcaaaagagagctagtgatggccagaatctctctattgggtactgaatacttcgaagacctactattgcaccaccacacttccaccaatgctggcgccgctgactcccaagaattggtcgccgaaatcagagaaaagcaattccaccctgccaacttgcccgccagtgaggtattaaggttgaagcacgagcatttgaacgatatcaccaacttgaccaacaactttggaggtcgtgtcgtcgacatcagcgaaacaagctgtattgtggagttgtctgcaaaacccacacgtatctctgccttcttgaagttggtcgagccattcggtgtcctagagtgtgcaagaagcggtatgatggcattgccaagaactcctttgaagacaagcaccgaggaagctgccgacgaagacgaaaagatcagcgaaatcgtcgacatttcccaactaccacctggttag

SEQ ID NO: 697 - DNA, 2064 bp, Saccharomyces cerevisiae
atgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagcccgctgaaccttcaaaattggctaagaaactacgcgctgagcctgacatggatacctctttcgtcggtttaactggtggtcaaatatttaacgaaatgatgtccagacaaaacgttgatactgtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgttacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattggatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgctcaaataaataaatggaagaaggaatacccatacgcttatatggaggagactccaggatctaaaattaaaccacagacggttataaagaaactatccaaggttgccaacgacacaggaagacatgtcattgttacaacgggtgtggggcaacatcaaatgtgggctgctcaacactggacatggagaaatccacatactttcatcacatcaggtggtttaggtacgatgggttacggtctccctgccgccatcggtgctcaagttgcaaagccagaatctttggttattgacattgatggtgacgcatcctttaacatgactctaacggaattgagttctgccgttcaagctggtactccagtgaagattttgattttgaacaatgaagagcaaggtatggttactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactga

SEQ ID NO: 698 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 699 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 700 - DNA, 1182 bp, Saccharomyces cerevisiae
atgttgcagagacattccttgaagttggggaaattctccatcagaacactcgctactggtgccccattagatgcatccaaactaaaaattactagaaacccaaatccatccaagccaagaccaaatgaagaattagtgttcggccagacattcaccgatcatatgttgaccattccttggtcagccaaagaagggtggggcactccacacatcaagccttacggtaatctttctcttgacccatctgcttgtgtattccattatgcatttgaattatttgaaggtttgaaagcctacagaactcctcaaaatactatcaccatgttccgtccggataagaacatggcccgtatgaacaagtctgccgctagaatttgtttgccaactttcgaatctgaagaattgatcaaacttaccgggaaattgatcgaacaagataaacacttggttcctcaaggtaatggttactcattatacatcagaccaacaatgattggtacatccaagggtttaggtgttggcactccctccgaggctcttctttatgttattacttctccagtcggtccttattataagactggtttcaaagccgtacgtcttgaagcaacagactatgctacaagagcttggccaggtggtgttggcgacaaaaaattgggtgctaactatgccccatgcatcttacctcaactacaagctgccaaaagagggtaccaacaaaatctatggttgttcggcccagaaaagaacatcactgaggttggtactatgaacgtgttcttcgttttcctcaacaaagtcactggcaagaaggaattggttaccgctccattagatggtaccattttagaaggtgttaccagagactctgttttaacattggctcgtgacaaactagatcctcaagaatgggacatcaacgagcgttattacactattactgaagtcgccactagagcaaaacaaggtgaactattagaagccttcggttctggtactgctgctgtcgtttcacctatcaaggaaattggctggaacaacgaagatattcatgttccactattgcctggtgaacaatgtggtgcattgaccaagcaagttgctcaatggattgctgatatccaatacggtagagtcaattatggtaactggtcaaaaactgttgccgacttgaactaa

SEQ ID NO: 701 - DNA, 1131 bp, Saccharomyces cerevisiae
atgaccttggcacccctagacgcctccaaagttaagataactaccacacaacatgcatctaagccaaaaccgaacagtgagttagtgtttggcaagagcttcacggaccacatgttaactgcggaatggacagctgaaaaagggtggggtaccccagagattaaaccttatcaaaatctgtctttagacccttccgcggtggttttccattatgcttttgagctattcgaagggatgaaggcttacagaacggtggacaacaaaattacaatgtttcgtccagatatgaatatgaagcgcatgaataagtctgctcagagaatctgtttgccaacgttcgacccagaagagttgattaccctaattgggaaactgatccagcaagataagtgcttagttcctgaaggaaaaggttactctttatatatcaggcctacattaatcggcactacggccggtttaggggtttccacgcctgatagagccttgctatatgtcatttgctgccctgtgggtccttattacaaaactggatttaaggcggtcagactggaagccactgattatgccacaagagcttggccaggaggctgtggtgacaagaaactaggtgcaaactacgccccctgcgtcctgccacaattgcaagctgcttcaaggggttaccaacaaaatttatggctatttggtccaaataacaacattactgaagtcggcaccatgaatgcttttttcgtgtttaaagatagtaaaacgggcaagaaggaactagttactgctccactagacggtaccattttggaaggtgttactagggattccattttaaatcttgctaaagaaagactcgaaccaagtgaatggaccattagtgaacgctacttcactataggcgaagttactgagagatccaagaacggtgaactacttgaagcctttggttctggtactgctgcgattgtttctcccattaaggaaatcggctggaaaggcgaacaaattaatattccgttgttgcccggcgaacaaaccggtccattggccaaagaagttgcacaatggattaatggaatccaatatggcgagactgagcatggcaattggtcaagggttgttactgatttgaactga

SEQ ID NO: 702 - DNA, 1365 bp, Saccharomyces cerevisiae; identical to SEQ ID NO: 650

SEQ ID NO: 703 - DNA, 1374 bp, Saccharomyces cerevisiae; identical to SEQ ID NO: 651

SEQ ID NO: 704 - DNA, 1113 bp, Saccharomyces cerevisiae
atggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacgctaacgtttccaccaaggaaatgagacaaccaggtggtacgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 705 - DNA, 6645 bp, Saccharomyces cerevisiae; identical to SEQ ID NO: 675

SEQ ID NO: 706 - DNA, 1725 bp, Saccharomyces cerevisiae
atgtggaggagaatattcgcgcatgaactcaagtatgatcaacccaatgcatcttcaaaaaacttgatcctttcagttctgaatacaaccgctacaaaacgagaggctaaggattatctctcaaaatatacaaatgatagtgggcagcataatcattgtttgttttttatcagggacctgcataaagtcgcaccagcgattttgtcccagttttcaagtgtcataaagagactaggaatgctaggtttgcgacctatgtttgtaattccgccgtcgccaactcatgtaaatatacaggcagagttacttgacagtatcgttacagaagcagatttaaagccacttcaccttaaggagggtcttactaaatcccgcactgggttatatcattctgttttttcgcaagagagtcgtttctttgatattggaaattccaattttataccaattgtgaaaccttatgtgtataatgaagagactgcttcagaattcatgacaaaggatgttgtaaaatttatggattgcctgtgccaagggaatattccacacattgacaaattcttcattctaaataatgccggaggtataccttcgggagagagaaatgataacgctcatgtattcatcaatctttctcaggaactcgagcatttgtcctcgtcattatctcacaatataagcactctaaccaaacgagagccacgctcccaaaacctgttacacagaatggaggtgtacgttaaaaaagatgagatatcttccttagaatgtgaataccatgatcatttagaaaacctgttattgatggacaaagttttatcaaatctagcggctacagcaacgggactgattacaactgtcaaagctgccgcactatcatcagataggaaaaatcctttagtatataatttattgacagaccgatcgctaatttcttcttctttaccaaggtttaaaaaaaaggacggcgagatagactcaccagccaacatgtttgatgatcacgcatggtatgaattgccttcccaacaggtaaatgcagctccttctaactcagatgcagttttagtgacaactgttctcaaaaagggcgtccatatcaaaacttatgactataagacgctgactcaattcaactcaattgggcttccaaagaagtttcacgtacctgagaaaggagcaaaaccctcgagcaatagtccaaaactagatatcaacaaatttaaatccatcatcgatcagagctttaaaagatctttggatttgcatgactacataaaaaggattaatggaaaaatagctacaattattgtgataggtgattatgaaggcattgcaattcttacctatgaaggctcggaggaaaattcctttgtttatctcgataagttcgccgttctaccacacttgaaaggctcgctgggtatatctgatataatcttcaatttgatgttcaaaaaatttcctaatgagatactttggagaagcagaaaagacaatgtggtgaacaagtggtattttcaacgtagcgttgctgtgctagatttgtcgattgacttagaccccgaacactgtgatgaaaagcaaagccaatttaaactattttactacggtaaccctcaatacgctaagagggcactacgtgacaagaaacgtttaagagaattcatgaggtctgtcagggacatcaagccaagttgggaaaatgaaaaaaatatttcatga

SEQ ID NO: 707 - DNA, 1272 bp, Saccharomyces cerevisiae
atgtttaaaagatatttatccagtacgtcatcaagaagatttacaagcattttagaggaaaaggcctttcaagtgaccacttactctagacctgaagatctatgtataactagaggtaaaaatgcaaagctgtatgatgacgtgaatggtaaagaatatatcgatttcaccgcaggtattgcggtgaccgcattaggccatgcaaatcctaaagtggcagaaattctgcaccatcaggctaacaaactggttcattcctccaacctttacttcactaaggaatgtttggatttaagtgaaaagattgttgaaaagaccaagcaattcggtggtcaacacgacgcctcaagagtatttttatgtaattctggtacggaagcaaatgaagctgctttgaagtttgcaaagaaacatggtataatgaaaaatcctagcaagcaaggcattgttgcatttgagaactcttttcatggccgtactatgggcgctttatctgtcacttggaatagtaaatatagaactccttttggggatttggttccccatgtctcattcttaaatttgaatgacgaaatgaccaaactacaaagttatatcgagaccaaaaaggacgagattgctggtttaattgtcgagcccatacaaggtgaaggtggggtttttcccgtagaagttgaaaagctaaccggattgaagaaaatatgtcaagataatgatgtgattgtcattcatgatgaaattcaatgcggtttgggccgttcaggtaaactatgggctcatgcttatttaccaagtgaggctcatccggatatttttacatctgccaaagcattgggaaatggcttccccatcgctgccaccatcgtcaatgaaaaagttaataatgctttgagagttggtgaccacggcaccacgtatggtggtaatccgctggcctgttctgtaagcaactatgttttggataccatagcagacgaagcttttttgaaacaagtctctaagaagagtgatatcttacaaaagcgcttgcgcgaaattcaagccaaatatccaaatcaaataaagactatcagaggaaaaggtttgatgcttggtgctgagttcgtcgaaccacccaccgaggtcatcaaaaaggccagagaattgggacttttgatcattaccgctggtaagagtaccgttagatttgttcccgcattaacgattgaagacgaactaatcgaagaagggatggatgcttttgaaaaggctattgaagcggtttacgcttaa

SEQ ID NO: 708 - DNA, 1017 bp, Saccharomyces cerevisiae
atgtcaaccacagcatccacgccttcatctttacgtcatttgatttctataaaagatctttctgatgaagaattcagaatcttagtacaaagagctcaacatttcaagaatgtttttaaagcaaataaaacgaatgatttccaatccaaccatctgaaactattgggtagaactatagccttaatatttactaaaagatcaactagaacgagaatttcgaccgaaggtgcagccaccttctttggtgcccaaccgatgtttttaggtaaagaggatattcagcttggtgtcaatgaatcattttacgataccaccaaggttgtatcatctatggtttcatgtatttttgcccgtgtgaacaaacatgaagacatacttgctttttgcaaggattcctctgtaccgatcatcaactctctatgtgacaaattccaccctttgcaagcaatttgtgatcttttaacaataatcgaaaacttcaatatatctctagatgaagtaaataagggaatcaattcaaaattgaagatggcatggattggtgatgccaataatgtcataaatgatatgtgcatcgcatgtctgaaattcggtataagtgtcagtatttccactccccccggtattgaaatggattccgatattgtcgatgaagcaaagaaagttgctgagagaaacggtgcgacatttgaattaacacacgactctttaaaggcctccaccaatgccaatatattagtaaccgatactttcgtttccatgggtgaagaatttgcgaaacaggccaagctgaaacaattcaaaggttttcaaatcaatcaagaacttgtctctgtggctgatccaaactacaaatttatgcattgtctgccaagacatcaagaagaagttagtgatgatgtcttttatggagagcattccatagtctttgaagaagcagaaaacagattatatgcagctatgtctgccattgatatctttgttaataataaaggtaatttcaaggacttgaaataa

SEQ ID NO: 709 - DNA, 1263 bp, Saccharomyces cerevisiae
atgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggtttcctacttcacccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaa

SEQ ID NO: 710 - DNA, 1392 bp, Saccharomyces cerevisiae
atgtcagacggcactcaaaaactatggggtgggagattcactggtgaaaccgatcctttgatgcacctttacaatgcgtctcttccgtatgattataagatgtataaggcagatttagaaggaactaaagtatacacagcgggcttgcagaagttgggtcttctaacggagacagaattggcaaagatccatgaaggtttggctgaaatcaaaaaagaatgggacgctgacaaatttgtccgtcatccaaacgacgaggatatccatactgcgaatgaaagacgtcttggtgaactaattggccgcgatattgctggtaaagtccacaccggtagatcccgtaatgatcaagttgttaccgatttgagaatatactgtcgtgacattgtcaatgacaccctctttccagctttaaagggcttggttgaagttctaattaagagggccgaaggtgagatagatgtcttaatgccaggctacacacatttacaaagggcacaacctattagatggtctcattggttgagctcttatgcaacatacttcaccgaagattacaagagactgggtcaaatactacacagattgaatcaatcaccactgggtgcaggcgctcttgctggtcatccttacggcattgatagagaatttttggctgaaggtttgggtttcaatagtgtaattggtaactccttggttgctgtttctgatagagatttcatcgtggagttgatgttttggggaactttgttcatgaaccatatttctcgttttgctgaagatttgattatatattgtacagcagaatttggtttcatacagttgagcgacgcctattcaacaggttcttctttaatgcctcagaagaagaatgcagactcgttagagttgttaagaggtaaatccggtagagtatttggtgatctgacaggattcttgatgagtttgaagggtatcccatctacttatgataaagacatgcaagaagacaaagagccactattcgattgcttaacaactgtagagcactccatgctgattgccacaggtgttatttctaccttaactgtaaataaggaaaagatggaagctgctctcacgatggatatgctagctaccgacttggcagattacttggtcagaaagggtgttccattcagagagactcatcacatatctggtgagtgtgtcgctactgctgaaagacttggtctaagcggtattgataaattaaccttggagcagtatcaaaagatcgattcgagattcggacaagatctttttgaaacttttaactttgaacaaagcgttgaaagacgagatgctactggtggaaccgctaaatctgctgtattgaagcaattggataatttgaaatcccaattaaattag

SEQ ID NO: 711 - DNA, 1401 bp, Saccharomyces cerevisiae
atgtctagtactcaagtaggaaatgctctatctagttccactactactttagtggacttgtctaattctacggttacccaaaagaagcaatattataaagatggcgagacgctgcacaatcttttgcttgaactaaagaataaccaagatttggaacttttaccgcatgaacaagcgcatcctaaaatatttcaagcgctcaaggctcgtattggtagaattaataatgaaacgtgcgaccccggtgaggagaactcgtttttcatatgcgatttgggagaagtcaagagattattcaacaactgggtgaaggagcttcctagaattaagccattttatgccgtcaaatgtaatcctgataccaaggttttgtcattattagcagagttgggcgttaatttcgattgcgcttccaaagtggaaattgacagagtattatcgatgaacatctcgccggatagaattgtttacgctaatccttgtaaagtagcatctttcattagatatgcagcttcaaaaaatgtaatgaagtctacttttgacaatgtagaagaattgcataaaatcaaaaagtttcatcctgagtctcagttgttattaagaatcgctaccgatgactctaccgctcaatgtcgactttccaccaaatatggctgtgaaatggaaaacgtagacgttttattaaaggctataaaggaactaggtttaaacctggctggtgtttctttccacgtcggttcaggcgcttctgattttacaagcttatacaaagccgttagagatgcaagaacggtatttgacaaagctgctaacgaatacgggttgccccctttgaagattttggatgtaggtggtggatttcaatttgaatccttcaaagaatcaactgctgttttgcgtctagcgctagaggaatttttccctgtaggttgtggtgttgatataattgcagagcctggcagatactttgtagctacagcgttcactttggcatctcatgtgattgcgaagagaaaactgtctgagaatgaagcaatgatttacactaacgatggtgtatacgggaacatgaattgtattttattcgatcatcaagagccccatccaagaaccctttatcataatttggaatttcattacgacgattttgaatccactactgcggtcctcgactctatcaacaaaacaagatctgagtatccatataaagtttccatctggggacccacatgtgatggtttggattgtattgccaaagagtattacatgaagcatgatgttatagtcggtgattggttttattttcctgccctgggtgcctacacatcatcggcggctactcaattcaacggctttgagcagactgcggatatagtatacatagactctgaactcgattga

SEQ ID NO: 712 - DNA, 882 bp, Saccharomyces cerevisiae
atggcacaagaaatcactcacccaactattgtagacggctggttcagagaaatttctgataccatgtggccaggccaggccatgactttaaaagtggagaaagttttacaccatgagaagtcaaaatatcaagacgttttgatcttcaaatccactacatatggtaatgttctagttttagataatgtaattcaagccaccgaaagggatgaatttgcctaccaagaaatgattgcccatcttgccttgaattcccatccaaatcctaagaaggttcttgttattggtgggggtgatggtggtgttttgagagaggttgtcaagcatgattccgttgaggaagcctggttatgtgacattgatgaagctgttattagactatcaaaggagtacctaccagaaatggctgcctcttattctcacccaaaggttaagacccacattggtgatggtttccaatttttaagagattaccaaaacacatttgacgtaatcattactgactcttctgacccagaaggtccagctgaaacccttttccaaaaggaatatttccaattgttgaacagtgcgttgacagaaaagggtgtaatcactacacaagcagaaagtatgtggattcacttgccaatcattaaggacttaaagaaagcctgttctgaagttttcccagttgcagaatactctttcgttactattccaacttacccaactggtacgattggttttatggtttgctccaaagataaaacttgcaatgtcaagaagccactacgtgaaatctctgatgagaaggaggctgaattatacagatactataacaagaaaattcacgaagcttcctttgttctaccaacctgggcagccaaggaattaaattag

SEQ ID NO: 713 - DNA, 1191 bp, Saccharomyces cerevisiae
atgactgtcaccataaaagaattgactaaccacaactacattgaccacgaactatcagccactttagactcaacggatgcgttcgagggtcccgagaagttgctggaaatctggttcttccctcacaagaagtccatcacgaccgaaaagacattaagaaatattggcatggatagatggatcgagattttgaaattagtgaaatgcgaagttctttccatgaagaagactaaagaactggatgcctttttgttgagtgagtcttccctcttcgtcttcgatcacaaattgacgatgaagacgtgcggtactacaaccacattgttctgtctcgaaaagcttttccagatcgttgagcaagagttatcgtgggctttccgcacaacacaagggggcaagtacaaaccatttaaagtgttttattctagacgatgtttccttttcccctgtaagcaagccgctatccatcaaaactgggctgacgaagtcgactatttgaacaaatttttcgacaatggtaaaagttattccgtgggaagaaatgacaagagcaaccactggaacctgtacgtcaccgagacggaccgctccacacctaagggaaaggagtacatcgaggatgacgacgaaactttcgaagtactgatgacggagctggacccagaatgcgctagtaagtttgtttgcgggcctgaggcatccacaaccgctctcgtggagccaaacgaagataagggccacaacctcggctaccaaatgactaaaaatacaaggcttgacgaaatatatgtcaactcggcccaagactccgatttatcatttcaccacgatgcatttgcgttcacgccatgtggatactcatccaatatgattctcgctgaaaaatactattacaccctgcacgtgactccggaaaagggttggtcttacgcctctttcgaaagtaacatacccgtatttgacatttcccaagggaagcaagacaacttggacgttcttctacatattctgaacgtttttcaaccaagagagttctcgatgaccttttttaccaaaaattatcagaaccaatccttccaaaaactactaagcatcaacgagtcactgcccgactacatcaagttagacaaaattgtttatgatctggacgactaccaccttttctatatgaaattgcagaagaaaatatga

SEQ ID NO: 714 - DNA, 1494 bp, Saccharomyces cerevisiae; identical to SEQ ID NO: 652

SEQ ID NO: 715 - DNA, 1416 bp, Saccharomyces cerevisiae
atgtctatttgtgaacaatactacccagaagagccaaccaaaccaactgttaagaccgagtccattcctggtcctgaatcccagaagcagttaaaggaactgggtgaagtttttgacacaagaccagcatattttttggctgattatgagaaatctttaggtaactatatcactgatgtggatgggaacacatatttggatttgtatgcccaaatctcttcaattgcacttggttataacaaccctgctttgatcaaggcagcacaatcaccagaaatgatccgtgctttggtcgaccgtcctgccttaggtaacttcccatctaaggatttagacaagatattgaagcaaatattgaaatctgcgccaaagggtcaagatcacgtctggtcagggctttccggtgcagatgccaatgaattagcgttcaaggctgcctttatttattaccgtgccaaacaaaggggctatgatgccgatttttctgaaaaggaaaacttgtctgtcatggacaatgacgcccctggcgcccctcatcttgccgtactatcgttcaagagagcgttccacggtagattgtttgcctccggttccacaacttgttctaaaccaattcacaagttggatttcccagccttccactggcctcatgctgagtatccatcttaccaatacccattagatgaaaattctgatgcaaaccgtaaagaggatgaccattgcttggccattgttgaagaattaatcaaaacctggtctattccagttgctgccttaatcatcgaaccaattcaatctgagggaggtgataaccacgcttctaagtatttcttacaaaagctaagagacattaccttgaagtataacgttgtctacatcatagatgaagtgcaaacaggtgtcggagccaccggtaagctatggtgtcatgagtacgccgatattcaaccacctgtggatttagtgaccttttccaagaaattccaaagtgcaggatatttcttccacgaccctaaattcattccaaacaaaccatacagacaattcaacacatggtgtggtgaacctgcaagaatgatcattgcaggtgccattggacaggaaatctccgacaagaagttgactgaacaatgttcaagagtaggtgattatttgttcaagaaattggagggtttgcagaagaaataccctgaaaactttcaaaacttgagaggtaaaggaagaggcacattcattgcctgggatttgcctactggtgagaagagagacttactattgaagaaattgaagttgaatggttgcaacgttggtggatgtgcagtccatgcagtgagattaagaccttcattaacattcgaggagaagcatgctgatatctttattgaagcattagccaaatcagttaatgaattatga

SEQ ID NO: 716 - DNA, 1323 bp, Saccharomyces cerevisiae; identical to SEQ ID NO: 648

SEQ ID NO: 717 - DNA, 1287 bp, Saccharomyces cerevisiae; identical to SEQ ID NO: 649

SEQ ID NO: 718 - DNA, 2082 bp, Saccharomyces cerevisiae
atgctacgatcaaccacatttactcgttcgttccacagttctagggcctggttgaaaggtcagaacctaactgaaaaaattgttcagtcgtatgcggtcaaccttcccgagggtaaagttgtgcattctggtgactatgtatcgatcaagccggcacactgtatgtcccacgataattcgtggcctgtagctttgaaattcatggggcttggcgctaccaagatcaagaatccttcacagattgtgaccactctggaccacgatattcagaacaaatcagagaaaaatttgaccaagtacaagaacatcgaaaattttgctaagaaacaccatatagaccactaccctgccggtagaggtattggtcatcaaattatgattgaggagggctatgctttccccttgaacatgactgtcgcatctgactcgcattcaaacacctacggtggtctggggtcgctgggcactccaatagtgagaacagacgctgcagccatatgggccacgggacagacgtggtggcagatcccaccagtggctcaggttgagttgaaaggtcaattgcctcagggtgtttccggaaaagatatcattgtcgcattatgtgggcttttcaacaatgatcaagttctaaatcacgccattgaattcacgggtgactctttgaatgcattgcctatcgatcacagactcactattgctaacatgaccaccgagtggggggctctttctggtttgttccccgtggacaaaactttgatcgactggtataaaaaccgtttgcaaaagctgggcaccaataatcatccaaggattaatccaaagactatccgcgcactagaagaaaaggcgaagattccgaaagcagacaaggatgcacattatgccaagaaactgatcatcgatctagccacgctaactcactacgtctcaggtccaaatagtgttaaggtctccaacaccgtgcaagatctatctcaacaagacatcaagataaataaagcttatctagtgtcatgtacaaactcccgtctatctgatttgcaatctgcagcggatgtggtttgtcctactggagacttaaacaaagtcaacaaggtggctccaggtgtggagttctatgtcgctgctgcctcttcagaaattgaggctgatgcccgtaaatcaggcgcttgggaaaagctgctaaaggctggctgtatcccactgccttctggttgtggtccatgcatcggtctaggtgcgggattactggaaccaggtgaagttggtatcagtgccacaaacagaaacttcaaaggtagaatgggttccaaggatgcattggcttacttagcttcccctgctgtagtcgccgcttctgccgtgctgggtaagattagttctcctgctgaggtattgtccacaagcgaaattccattcagcggcgttaagactgagataattgagaatcccgtggttgaagaggaagttaacgctcaaacagaggctccaaaacaatccgttgagatattagaaggtttcccaagagagttttctggtgaattagttttatgtgatgccgataacatcaataccgatggtatatatcctggtaagtacacttatcaggatgatgtgcctaaagaaaagatggcgcaagtttgtatggaaaattatgatgccgagttcagaaccaaggttcatccaggtgatatagtggtcagtgggttcaatttcggtaccggttcctccagggaacaagcggccaccgccttattggctaaaggtatcaacttagttgtttcaggatcttttggtaatattttttcaagaaactccattaacaatgctcttctgaccttggaaatcccagcattaatcaaaaaattacgtgagaaatatcaaggtgctccaaaagaacttacaagaagaactggttggtttttgaaatgggatgtagctgatgctaaagtggtcgttaccgaaggttctttggacggccctgtgatcttggagcaaaaagtgggtgagctaggtaagaacctacaagaaattattgtaaaaggaggcttggaaggttgggtcaaatcccaactataa

SEQ ID NO: 719 - DNA, 1116 bp, Saccharomyces cerevisiae
atgtttagatctgttgctactagattatctgcctgccgtgggttagcatctaacgctgctcgcaaatcactcactattggtcttatccccggtgacggtatcggtaaggaagtcattcctgctggtaagcaagttttggaaaaccttaactccaagcacggcctaagcttcaactttattgatctctacgccggtttccaaacattccaagaaacaggaaaggcgttgcctgatgagactgttaaagtgttgaaggaacaatgtcaaggtgctcttttcggtgcagttcagtctccaactactaaggtggaaggttactcctcaccaattgttgctctaaggagggaaatgggccttttcgctaatgttcgtcctgttaagtctgtagagggagaaaagggtaaaccaattgacatggttatcgtcagagaaaatactgaggacctgtacattaaaattgaaaaaacatacattgacaaggccacaggtacaagagttgctgatgccacaaagagaatatccgaaattgcaacaagaagaattgcaaccattgcattagatattgccttgaaaagattacaaacaagaggccaagccactttgacagtgactcataaatcaaatgttctatctcaaagtgatggtctattcagagaaatctgtaaggaagtctacgaatctaacaaggacaagtacggtcaaatcaaatataacgaacaaattgtggattccatggtttataggctgttcagagaaccacaatgttttgatgtgatagtggcaccaaacctatacggggatatattatctgacggtgctgctgctttagtcggttcattaggtgttgttccaagcgccaacgtaggtccagaaattgtcattggtgaaccatgccatggttctgcaccagatattgctggtaaaggtattgctaacccaatcgccactataagatctactgctttgatgttggaattcttgggccacaacgaagctgcccaagatatctacaaggctgttgatgctaacttaagagagggttctatcaagacaccagatttaggtggtaaggcttctactcaacaagtcgttgacgacgttttgtcgagattatag

SEQ ID NO: 720 - DNA, 4179 bp, Saccharomyces cerevisiae
atgactaacgaaaaggtctggatagagaagttggataatccaactctttcagtgttaccacatgactttttacgcccacaacaagaaccttatacgaaacaagctacatattcgttacagctacctcagctcgatgtgcctcatgatagtttttctaacaaatacgctgtcgctttgagtgtatgggctgcattgatatatagagtaaccggtgacgatgatattgttctttatattgcgaataacaaaatcttaagattcaatattcaaccaacgtggtcatttaatgagctgtattctacaattaacaatgagttgaacaagctcaattctattgaggccaatttttcctttgacgagctagctgaaaaaattcaaagttgccaagatctggaaaggacccctcagttgttccgtttggcctttttggaaaaccaagatttcaaattagacgagttcaagcatcatttagtggactttgctttgaatttggataccagtaataatgcgcatgttttgaacttaatttataacagcttactgtattcgaatgaaagagtaaccattgttgcggaccaatttactcaatatttgactgctgcgctaagcgatccatccaattgcataactaaaatctctctgatcaccgcatcatccaaggatagtttacctgatccaactaagaacttgggctggtgcgatttcgtggggtgtattcacgacattttccaggacaatgctgaagccttcccagagagaacctgtgttgtggagactccaacactaaattccgacaagtcccgttctttcacttatcgcgacatcaaccgcacttctaacatagttgcccattatttgattaaaacaggtatcaaaagaggtgatgtagtgatgatctattcttctaggggtgtggatttgatggtatgtgtgatgggtgtcttgaaagccggcgcaaccttttcagttatcgaccctgcatatcccccagccagacaaaccatttacttaggtgttgctaaaccacgtgggttgattgttattagagctgctggacaattggatcaactagtagaagattacatcaatgatgaattggagattgtttcaagaatcaattccatcgctattcaagaaaatggtaccattgaaggtggcaaattggacaatggcgaggatgttttggctccatatgatcactacaaagacaccagaacaggtgttgtagttggaccagattccaacccaaccctatctttcacatctggttccgaaggtattcctaagggtgttcttggtagacatttttccttggcttattatttcaattggatgtccaaaaggttcaacttaacagaaaatgataaattcacaatgctgagcggtattgcacatgatccaattcaaagagatatgtttacaccattatttttaggtgcccaattgtatgtccctactcaagatgatattggtacaccgggccgtttagcggaatggatgagtaagtatggttgcacagttacccatttaacacctgccatgggtcaattacttactgcccaagctactacaccattccctaagttacatcatgcgttctttgtgggtgacattttaacaaaacgtgattgtctgaggttacaaaccttggcagaaaattgccgtattgttaatatgtacggtaccactgaaacacagcgtgcagtttcttatttcgaagttaaatcaaaaaatgacgatccaaactttttgaaaaaattgaaagatgtcatgcctgctggtaaaggtatgttgaacgttcagctactagttgttaacaggaacgatcgtactcaaatatgtggtattggcgaaataggtgagatttatgttcgtgcaggtggtttggccgaaggttatagaggattaccagaattgaataaagaaaaatttgtgaacaactggtttgttgaaaaagatcactggaattatttggataaggataatggtgaaccttggagacaattctggttaggtccaagagatagattgtacagaacgggtgatttaggtcgttatctaccaaacggtgactgtgaatgttgcggtagggctgatgatcaagttaaaattcgtgggttcagaatcgaattaggagaaatagatacgcacatttcccaacatccattggtaagagaaaacattactttagttcgcaaaaatgccgacaatgagccaacattgatcacatttatggtcccaagatttgacaagccagatgacttgtctaagttccaaagtgatgttccaaaggaggttgaaactgaccctatagttaagggcttaatcggttaccatcttttatccaaggacatcaggactttcttaaagaaaagattggctagctatgctatgccttccttgattgtggttatggataaactaccattgaatccaaatggtaaagttgataagcctaaacttcaattcccaactcccaagcaattaaatttggtagctgaaaatacagtttctgaaactgacgactctcagtttaccaatgttgagcgcgaggttagagacttatggttaagtatattacctaccaagccagcatctgtatcaccagatgattcgtttttcgatttaggtggtcattctatcttggctaccaaaatgatttttaccttaaagaaaaagctgcaagttgatttaccattgggcacaattttcaagtatccaacgataaaggcctttgccgcggaaattgacagaattaaatcatcgggtggatcatctcaaggtgaggtcgtcgaaaatgtcactgcaaattatgcggaagacgccaagaaattggttgagacgctaccaagttcgtacccctctcgagaatattttgttgaacctaatagtgccgaaggaaaaacaacaattaatgtgtttgttaccggtgtcacaggatttctgggctcctacatccttgcagatttgttaggacgttctccaaagaactacagtttcaaagtgtttgcccacgtcagggccaaggatgaagaagctgcatttgcaagattacaaaaggcaggtatcacctatggtacttggaacgaaaaatttgcctcaaatattaaagttgtattaggcgatttatctaaaagccaatttggtctttcagatgagaagtggatggatttggcaaacacagttgatataattatccataatggtgcgttagttcactgggtttatccatatgccaaattgagggatccaaatgttatttcaactatcaatgttatgagcttagccgccgtcggcaagccaaagttctttgactttgtttcctccacttctactcttgacactgaatactactttaatttgtcagataaacttgttagcgaagggaagccaggcattttagaatcagacgatttaatgaactctgcaagcgggctcactggtggatatggtcagtccaaatgggctgctgagtacatcattagacgtgcaggtgaaaggggcctacgtgggtgtattgtcagaccaggttacgtaacaggtgcctctgccaatggttcttcaaacacagatgatttcttattgagatttttgaaaggttcagtccaattaggtaagattccagatatcgaaaattccgtgaatatggttccagtagatcatgttgctcgtgttgttgttgctacgtctttgaatcctcccaaagaaaatgaattggccgttgctcaagtaacgggtcacccaagaatattattcaaagactacttgtatactttacacgattatggttacgatgtcgaaatcgaaagctattctaaatggaagaaatcattggaggcgtctgttattgacaggaatgaagaaaatgcgttgtatcctttgctacacatggtcttagacaacttacctgaaagtaccaaagctccggaactagacgataggaacgccgtggcatctttaaagaaagacaccgcatggacaggtgttgattggtctaatggaataggtgttactccagaagaggttggtatatatattgcatttttaaacaaggttggatttttacctccaccaactcataatgacaaacttccactgccaagtatagaactaactcaagcgcaaataagtctagttgcttcaggtgctggtgctcgtggaagctccgcagcagcttaa

SEQ ID NO: 721 - DNA, 1341 bp, Saccharomyces cerevisiae
atgggaaagaacgttttgttgctaggatctggttttgttgcacaacctgttatcgacacattggctgctaatgatgacatcaatgtcactgtcgcatgtagaacattagccaatgcgcaagcattggccaagccctctggatccaaggctatttcattggatgttaccgatgacagtgccttagacaaagttctggctgataacgatgttgtcatctctttgattccatacaccttccatccaaatgtggtaaagagcgccatcagaacaaagaccgatgtcgtcacttcctcttacatctcacctgccttaagagaattggaaccagaaatcgtaaaggcaggtattacagttatgaacgaaattgggttggatccaggtatcgaccacttgtatgcggtcaagactattgatgaagttcacagagctggtggtaagctaaagtcattcttgtcatactgtggtggtttaccagctcctgaagactctgataatccattaggatacaaattttcatggtcctccagaggtgtgctactggctttaagaaactctgctaaatactggaaagacggaaagattgaaactgtttcttccgaagacttaatggccactgctaagccttacttcatctacccaggttatgcattcgtttgctacccaaatagagactctacccttttcaaggatctttatcatattccagaagccgaaacggtcattagaggtactttgagatatcaaggtttcccagaatttgttaaggctttagttgacatgggtatgttgaaggatgatgctaacgaaatcttcagcaagccaattgcctggaacgaagcactaaaacaatatttaggtgccaagtctacttctaaagaagatttgattgcttccattgactcaaaggctacttggaaagatgatgaagatagagaaagaatcctttccgggtttgcttggttaggcttgttctctgacgcaaagatcacaccaagaggtaatgctttagacactctatgtgcacgtttagaagaactaatgcaatatgaagacaatgaaagagatatggttgtactacaacacaaattcggtattgaatgggctgatggaactaccgaaacaagaacatccactttagttgactatggtaaggttggtggttacagttctatggccgctactgttggttatccagttgccattgcaacgaaattcgtcttagatggtacaatcaagggaccaggcttactagcgccatactcaccagagattaatgatccaatcatgaaagaactaaaggacaagtacggcatctatctaaaggaaaagacagtggcttaa

SEQ ID NO: 722 - DNA, 1122 bp, Saccharomyces cerevisiae
atggctgccgtcacattacatctaagagctgaaactaaacccctagaggcacgtgctgccttaacacctaccacggttaaaaaactgatagctaagggcttcaaaatatatgtagaggacagtccacaatctactttcaatattaacgaatatcgtcaagcaggtgccattatagtgcctgcaggttcatggaaaaccgctccacgcgacagaatcattataggtttgaaggaaatgcctgaaaccgatactttccctctagtccacgaacacatccagtttgctcactgctacaaagaccaagctgggtggcaaaatgtccttatgagatttattaagggacacggtactctatatgatttggaatttttggaaaatgaccaaggtagaagagttgctgcctttggattttacgctgggttcgcaggtgcagcccttggtgtaagagactgggcattcaagcaaacgcattctgacgatgaagacttgcctgcagtgtcgccttaccccaatgaaaaggcattggttaaagatgttaccaaagattataaagaagccttagccaccggagccagaaagccaaccgtgttaatcattggtgcgctaggaagatgtggttccggtgccatcgatctgttgcacaaagttggtattccagatgctaacatattaaaatgggatatcaaagaaacttcccgtggtggtccctttgacgaaattccacaagctgatatttttatcaattgtatatatctatcgaagccaattgctcctttcactaacatggagaaactgaataatcctaacagaagactaaggaccgtggtggacgtatcagcagacactaccaaccctcacaaccccatcccaatatacactgtggctactgtgtttaacaaacctaccgttctggtacctaccactgccgggcctaaattatctgtcatctctattgatcacttgccttctttgctgccaagagaagcttcagaatttttctctcatgatctcttaccatctttagagctcctacctcaaagaaaaactgctcctgtctgggttagagccaagaaattgttcgatagacattgcgctcgtgttaaaagatcttcaagattgtag

SEQ ID NO: 723 - DNA, 1533 bp, Saccharomyces cerevisiae
atgtgtggtattttaggtattgtattagcaaaccaaaccactccagtagctccggagttatgtgatggatgcatttttctacaacatcgtggacaagatgcagctggtatagctacctgtggttctcgtggtagaatctaccaatgtaaaggtaatggtatggctcgtgacgtatttacccaacaacgtgtttccggtcttgctggttccatgggtattgcccacttgagatatcctacagccgggtcttcggctaattcagaagcgcaaccattttacgtcaatagtccttacggtattaacttggcacataacggtaacttggtgaatactgcatcattgaagagatatatggatgaagacgttcatagacatattaacacggacagtgattcggagttactattgaatatttttgctgctgaactggaaaaacataacaagtacagagttaacaatgaagatgttttccacgcgttagaaggtgtttaccgtttatgccgtggcggttatgcttgcgttggtttacttgccggttttgcattatttggtttcagagatccaaatggtattaggccattattgttcggtgaaagagaaaatccggacggcactaaggactatatgttagcttcagaaagtgttgttttcaaagctcacaactttactaaatatcgtgacttaaagcctggcgaggcagttatcatccctaagaactgtagcaaaggtgaacctgagttcaaacaagtggttcctattaactcttatagacctgatttatttgaatacgtatatttcgccagaccggacagtgtcttggatggaatatcagtttatcacacaagattggctatgggttctaaattagcggaaaatattctaaagcaactgaagccagaagatattgatgttgttattcccgtcccagatactgcaagaacatgtgcactagaatgtgctaatgtgttagggaagccttatagagagggctttgttaaaaacagatacgtgggcaggacatttatcatgccaaaccagagggaaagggtttcttcagtaaggaggaagcttaaccctatggagtctgaatttaagggtaagaaggttctgatagtggatgattctattgtcagaggtactacttcaaaagagattgttaacatggccaaggaatccggtgcaacaaaggtttacttcgcttcagctgccccagccattcgttacaaccatatttatggtattgacttaacagacacaaagaacttgattgcttataacagaaccgatgaagaagtggcggaagtaatcggttgtgaaagagtcatttaccaatcattggaagatttgattgattgttgtaaaactgataaaataaccaaattcgaagatggtgtatttaccggaaattatgtcactggtgttgaagacggttatattcaagaattggaagaaaaacgtgaatcgatcgcaaataattcatcagatatgaaggctgaagtcgatatcggattatataattgtgcagattattga

SEQ ID NO: 724 - DNA, 645 bp, Saccharomyces cerevisiae
atggccagaattgtcgtattaatttcgggctcaggttccaacttgcaagccttgatcgatgcccaaaagcagggccaattaggcgaggatgctcatattgtctctgtcatatcttccagcaagaaggcatacgggttaactagggcagcggacaataatatccccacaaaggtttgttcgctatacccatatacaaagggtattgcgaaggaggacaaagccgcaagggccaaggcaagatcccagtttgagaacgacctcgcaaaactagtgctcgaggaaaagcctgacgttatcatctgcgcgggctggttattgatccttggatctactttcttgagccaactgcaatctgtgccgatattaaatctgcatccagcgctaccaggttgtttcgatggtaccacacacgcaattgaaatggcatggcgcaaatgtcaggacgagaacaagcctctgacggccggatgcatggtgcactatgtcatcgaggaggtcgacaagggtgagccattggtggtaaaaaagctagaaatcatacctggcgaagaaacactagagcagtacgagcaaagggtacacgatgctgagcacatcgcgattgtagaagctacatataaggttttacagcagcttcacaaataa

SEQ ID NO: 725 - DNA, 4077 bp, Saccharomyces cerevisiae
atgactgattatattttgccgggtcccaaggccttatctcagttcagagtcgataatctaattaaagatataaactcctatacaaacagtacttctgtcatcaatgaattgcgttcgtgttacattcactatgtcaacggcatcgctcaaaatttgtctgaacaggacactaaattgctagaagttttgttgacttacgattctgctttagatattgctaacgatccattagcaagacaattaaacgatgctgtcgctaataatttacccagttcagctcttggcgaagacacatatttgattagagttgttcctagatcaggcactatctctccttggtcttccaaggctactaatattgctcatgtatgcgggctacaagacaaagttcaacgtattgaaagaggtttagccttactcataaagactgttccaggtttccctcttttggaaaatctaaatgatatttcattgaagtgtgtctacgataggatgacacaacaattatatctgaccgaaccaccaaatacgatgagtattttcacacatgaagagccaaagccattagttcacgttcctttaactcctaaggacactaaacagtctccaaaggatattttatccaaagctaatacggaattgggtttagctctagatagtggagaaatggaatatttgattcatgcattcgtcgaaactatgaaaagagatcctactgatgttgagttatttatgttcgctcaagttaattctgaacattgtcgtcacaagatcttcaatgctgattggaccattgatggaataaaacaacaattcaccttgtttcaaatgattagaaatacccataaattaaacccagaatatactattagcgcctattctgataatgcagccgttttggatagtgaaaatgatgcctttttctttgcaccaaattcaactacaaaggaatggacctctacaaaggaaagaattccattacttatcaaagtcgaaactcacaaccatccaacagccgtgtctcctttcccaggtgctgctacaggttctggtggtgaaatcagagacgagggtgctacaggcagaggttccaagactaagtgtggtttgagtggattctctgtcagcgaccttttgataccaggtaatgaacaaccttgggagttgaatattggtaagccttaccatattgcatctgcattagatattatgattgaggctcctttgggttcagctgcatttaacaatgagtttggtagaccttgtataaacggttacttcagaactttaactacaaaggttttgaatcaccaagggaaggaggaaatcagagggttccacaagccaattatgattgcgggtggtttcggtactgttagacctcaatttgctttgaagaacaccccaataactccaggctcttgtttaattgtacttggtggtcaatctatgctgattggtttaggtggtggtgctgcttcttctgtagcttccggtgaaggttccgccgatttggattttgcttctgtacaaagagggaaccccgaaatggaacgtcgttgccaacaagtgattgacgcttgtgttgccttaggtaacaataatcctatccaatctattcacgatgttggtgctggtgggttatccaacgctttgccagaattggttcatgacaatgacttgggtgctaaattcgatattagaaaggtcctctccttagaacctggtatgtcaccaatggaaatttggtgtaatgaatcacaagaacgttatgttcttggtgtttctcctcaagacttatccattttcgaggaaatctgtaagagagaaagagcaccatttgctgtcgtcggtcacgcaaccgctgaacaaaaattgattgtagaagatcctcttttgaaaacaactccaattgatttagaaatgccaattttatttggtaagcctccaaagatgtcaagagaaaccataactgaagcactaaatctaccagaggcaaatttgagcgaaattccttccctacaagatgctattcaaagagttctaaacttaccatctgttggctcaaagtcatttttgattactattggtgacagatccgtcacaggtctaattgatagggatcaatttgttggtccttggcaagtacctgttgcggatgtcggtgttaccggtacctctttgggtgagacaataatttccacaggtgaagccatggctatgggtgaaaaaccagttaacgccctaatctccgcatctgcttccgctaaattatctgtggcagaatctttattgaacatattcgctgctgatgtgaaatctttaaatcatatcaagctatctgctaactggatgtctccagcctctcatcaaggtgagggttctaagttatatgaagccgttcaagcattaggtctggatttatgtcctgcattaggtgttgctatccctgttggtaaggattccatgtccatgaagatgaaatgggatgataaggaagttactgcaccattgtcattgaatatcacagcatttgcaccagttttcaacactagtaaaacgtggactccattgctaaatagaaacacagatgattctgtccttgtcttggttgatctatcagctaaacaagagactaagtcactaggtgcctctgctttgttgcaagtttacaaccaagttggtaacaagtcgcctactgtgtatgataacgccattttgaagggtttcttggaaagtttaatccaattgcatcaacaaaaggaggatatagtgcttgcctaccatgataggtctgatggtggtctactaatcactttactggaaatggcatttgcttccagatgcggcttagaaatcaacattgacggtggagacctagaaagtcaattaacaaacctattcaatgaagaattaggtgcagtattccagatttctgctaagaacttgagcaagttcgaaaaaatcttgaacgagaacggagttgctaaagaatatatttctattgttggtaagccatccttccaaagccaggaaatcaagattattaactccacaacaaatgatgtaatttacgccaattcgagatctgaattggagcaaacttggagtaagacatcttacgaaatgcagaaattgagagacaatccaaaaacagccgaagaagagtttgccagtatcacggacgatagagatcccggtttgcagtatgccctaacatacaacccagccgatgatatgaagatcggattagaattatccagtcaaaggccaaaggttgctatcttaagagagcaaggtgtgaacggtcaaatggaaatggcatggtgcttccaacaagctggattcaactcagtggatgtcactatgacagatttgctagaaggtaggttccatttggatgacttcatcggtcttgccgcatgtggtggtttctcttatggtgatgtcttaggtgcaggtgcgggttgggctaaatccgtattgtatcacgaaggtgtgcgctcgcaattttctaagttcttcaatgaaagacaagatacatttgcttttggtgcttgtaatggttgtcaattcttgagtagattaaaagatatcatacccgggtgtgaaaactggccaagtttcgaaagaaatgttagtgaacaatatgaagcccgtgtatgtatggtgcaaatatctcaagaaaaggacaattctagcgaggaatctgttttcttgaatggcatggcaggatccaaattgccaattgctgtcgcacatggtgaaggtaaagcaacattttctaaaagcgctgaacaactggaaaagttcgaaaaggatggtttatgttgtataaggtatgtggacaactacggtaacgtcaccgaaaggttccccttcaaccccaatgggtcgaccaatggtattgccggtatcaagtcaccaaatggtagagtgcttgccatgatgccacatcctgaaagagtttgcagattggaggccaattcctggtatccagagggcaaatacgaagagtggggtggatacggtccatggattagattattcagatctgccagaagatgggtcggttga

SEQ ID NO: 726 - DNA, 1716 bp, Saccharomyces cerevisiae
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaagtaa

SEQ ID NO: 727 - DNA, 921 bp, Saccharomyces cerevisiae
atgtcaattacgaagactgaactggacggtatattgccattggtggccagaggtaaagttagagacatatatgaggtagacgctggtacgttgctgtttgttgctacggatcgtatctctgcatatgacgttattatggaaaacagcattcctgaaaaggggatcctattgaccaaactgtcagagttctggttcaagttcctgtccaacgatgttcgtaatcatttggtcgacatcgccccaggtaagactattttcgattatctacctgcaaaattgagcgaaccaaagtacaaaacgcaactagaagaccgctctctattggttcacaaacataaactaattccattggaagtaattgtcagaggctacatcaccggatctgcttggaaagagtacgtaaaaacaggtactgtgcatggtttgaaacaacctcaaggacttaaagaatctcaagagttcccagaaccaatcttcaccccatcgaccaaggctgaacaaggtgaacatgacgaaaacatctctcctgcccaggccgctgagctggtgggtgaagatttgtcacgtagagtggcagaactggctgtaaaactgtactccaagtgcaaagattatgctaaggagaagggcatcatcatcgcagacactaaattcgaattcggtattgacgaaaagaccaatgaaattattctagtggacgaggtgctaacgccagactcctctagattctggaacggtgcctcttataaggtaggagaatcccaagattcttacgataagcaatttttaagagactggcttactgctaataagttgaacggtgttaacggcgtcaaaatgccccaagacattgtcgacaggacaagggccaaatatatagaggcttatgaaacattgacagggtctaaatggtctcactaa

SEQ ID NO: 728 - DNA, 1449 bp, Saccharomyces cerevisiae
atgcctgactatgacaattacactacgccattgtcttctagatatgcctccaaggaaatgtcagcaacgttttctttgagaaacagattttccacatggagaaaactatggttaaatttggctattgctgagaaggaattgggcttaactgttgttacagatgaagcaattgagcaaatgcgcaaacacgtcgaaatcactgatgatgaaatcgcaaaagcttctgctcaagaagccattgtaagacatgatgttatggcacatgttcatacatttggtgaaacttgtccggctgctgcgggtatcattcacttaggtgctacttcctgtttcgttacagacaatgctgatctaatctttattagggacgcctacgatattattattccaaaacttgttaacgtcatcaacagattggctaagtttgctatggaatacaaggatttgcctgtattgggttggactcactttcaaccagcacaattaacgaccttgggtaagagagctactttatggatacaagagctattgtgggatttgagaaactttgaaagagctagaaacgatatcggtctacgtggtgttaagggtactactggtactcaggcatcattcttggccttattccatggtaatcatgataaagttgaagcccttgacgaaagagtaactgaattattaggtttcgataaggtatatccagtcactggtcaaacctactcaagaaaaattgacattgacgtgttggctcctttgtcttcttttgctgctactgcacacaaaatggctactgacataagattattagccaacctgaaggaagttgaggaaccttttgagaaatcacaaatcggatcctctgctatggcttacaagagaaacccaatgcgttgtgagagagtgtgctccttggctagacacttaggttccttgtttagtgacgccgttcaaactgcatccgttcaatggttcgaaagaactctggatgattctgctattagaagaatttctttaccaagtgcatttttaaccgcagatattctattatctactttgttgaacatctcatccggtttagttgtgtatccaaaggttatcgaaaggagaattaagggtgaactaccttttatggctactgaaaatatcatcatggctatggtagaaaagaatgcctccagacaagaagtacatgagcgtattagagtgctctctcatcaagccgcagcagtagtcaaggaagaaggtggggaaaatgatttaattgaacgagtaaagagggatgaatttttcaagcctatctgggaagaattagattctttactggaaccatccacttttgttggtagagctccacaacaagttgagaaatttgttcaaaaagacgttaacaatgctttacaacctttccaaaagtacctaaacgatgaacaagtcaagttaaatgtttag

SEQ ID NO: 729 - DNA, 1779 bp, Saccharomyces cerevisiae
atggccaattacacaaaaaccgcaatcctatccgtctatgacaagacaggtctacttgatttagccagaggcctcatcgagaagaacgttcgtattctcgcctccggtggtactgctcgtatgattcgtgacgctggttttccaatcgaagacgtttctgctatcacacatgccccagaaatgttgggaggtagagtgaaaactttacatcctgccgttcatggtggtatccttgctagggacatcgatagcgatgagaaagacttgaaggaacagcacattgaaaaagtcgattatgtcgtttgtaacctatacccattcaaagaaactgttgctaaggtgggtgtgactattccagaagcagtagaagaaattgatattggtggtgttactctattaagagcagctgctaagaaccatgctagagtcactattttatctgatccaaaggactactccgaatttttaagtgaattatccagtaatggtgaaatctctcaagatttgagaaacagattggcattaaaggctttcgaacacactgccgattatgatgctgcaatttcagatttcttcaggaaacaatactctgaaggtcaagctcaaattactctacgttatggtgccaatccacaccaaaagccggctcaagcttacgtcagtcaacaagacagtttacctttcaaagtcctatgtggttcaccaggttacattaatttgttggatgctctaaattcctggcccctggttaaggaattatccgcctcgttgaatttaccagcagcagcatcgttcaagcatgtatcaccagctggtgccgctgtgggtatcccattgtctgatgttgaaaagcaagtttattttgttgccgacattgaaaacttatctcccctggcatgtgcctatgctagggcccgtggtgctgatagaatgtcttcctttggtgattggattgctctttccaacatagttgatgttccaacagctaagatcatatctagagaagtttctgatggtgttattgccccaggttatgagcctgaggcgttggccattctatccaagaagaagggaggtaagtactgcatattacaaattgatccaaactatgttccagaagctgtcgaaagaagacaagtatacggtgtgactttggaacaaaagagaaacgatgccataatcaatcaatcaactttcaaagaaattgtttctcaaaataaaaatctcactgaacaagccataattgatttaacggttgccaccattgctattaaatatactcaatctaattccgtatgttatgctagaaatggtatggttgtcggattgggtgcaggtcaacaatctagaatccattgtacaagattagctggtgataaggctgataattggtggttcagacaacaccctagagttttggagattaaatgggctaaaggcgtcaagagaccagaaaaatctaatgctatcgatttattcgtaaccggccaaattccaacagaagaaccagaattgtctgaataccaatcgaagttcgaggagattccaaaaccatttactccagaagaaagaaaggaatggttgagtaaattaaccaacgtttctttgtcatcggatgcatttttcccattcccagacaatgtttacagagcagttaaatccggtgtcaaatacattgccgctccatctggttctgtcatggacaaggttgtattttcagctgccgattcattcgatttggtttacgtagagaacccaatccgtttgttccaccattag

SEQ ID NO: 730 - DNA, 1776 bp, Saccharomyces cerevisiae
atgggcaaatataccaagactgcgatcttgtcagtttatgataagacaggtttattagacttagccaagggattggtagagaacaatgttcgtatcctagcatccggtggtacggccaacatggtcagagaagctggttttccggtcgacgatgtttcttcaattacgcatgcaccagaaatgctagggggtagagtcaagactcttcaccctgctgtgcatgcaggtattcttgccagaaatttagagggcgatgaaaaagatttaaaagagcagcacattgataaggtggattttgttgtatgtaatctatatccgttcaaagaaactgtggctaaaattggtgttacagttcaagaagctgtagaggagatcgacattggcggtgtgactttgttgagagcagccgcaaagaaccattccagagtgactattctttcagaccctaatgactattctatctttctgcaagacctgtctaaggacggtgaaatttctcaggatttaagaaatagatttgcacttaaggcgtttgaacatacggccgattatgatgcggccatttctgactttttcaggaaacagtactccgaagggaaagcccaattaccgctaagatatggttgtaatccccaccaaagacctgcacaagcttatatcactcagcaggaggagttgcccttcaaagtgctctgcggtacaccaggatatataaatcttttggatgccttgaactcatggcccttagtgaaagagttatctgcatcattgaacttgcctgcggcagcatcgttcaagcacgtttctccagcaggtgctgctgtgggacttccattatccgatgtggaaagacaagtttattttgtgaatgatatggaggatttatcaccattggcatgcgcatacgctagggcccgtggtgcagataggatgtcatcctttggtgatttcattgcattgtccaatattgtagatgtcgccactgcaaaaatcatctctaaagaagtttccgatggtgttattgctccagggtatgaaccagaggcattgaatatactatctaagaagaaaaacggaaaatactgtattttacaaatcgatccaaactatgttcctggccaaatggaatcccgagaggtttttggcgtaacgttacaacaaaagagaaacgatgcgatcataaaccaatccactttcaaagaaattgtctccaaaaacaaagcacttaccgagcaagccgttatcgatctaactgttgctacgctggttttaaaatacacacaatcaaattctgtttgctacgcaaagaatggtatggttgtggggcttggggccggccaacaatcgcgtatacactgtaccagattagctggtgacaagacggacaactggtggttgagacaacatccaaaggttttgaacatgaagtgggccaagggaattaagagagcggacaagtcgaatgcgattgatctttttgttacagggcaaagaatagaaggcccggaaaaggtggattacgaaagcaaatttgaagaagtccctgaacctttcaccaaagaagaaagactagaatggttaagcaaattaaacaatgtatcgttatcatccgatgcgttctttcccttcccagacaacgtttatagagctgtgcagtctggtgtaaagttcatcacggctccttcggggtctgtcatggacaaagttgtcttccaagcggcggattcatttgatatcgtctacgtggagaacccaattcgtttattccaccactaa

SEQ ID NO: 731 - DNA, 1578 bp, Saccharomyces cerevisiae
atggctgccggtgaacaagtttctaacatgtttgacactatcttagtgttagactttggttctcaatactctcatttgattaccagaagattaagagagtttaacatctatgctgagatgttgccatgcactcagaagatctctgagttgggctggactccaaagggtgtcattctttctggtggtccatattccgtatacgctgaagacgctccacacgtagaccatgctatctttgatttgaacgttccaatcctgggtatctgttacggtatgcaagaattggcttggattaatggtaaacaagttggtcgtggtgacaagagagagtacggtcctgccactttgaaggtgattgacgattccaactctctattcaaaggtatgaacgactctactgtctggatgtctcacggtgataaattgcacggcttgccaactggttacaagaccattgccacctccgataactccccatactgtggtattgtccacgaaactaagccaatctatggtattcaattccacccagaagttacacattctacccaaggtaagactcttttgaaaaacttcgccgttgatttgtgtcacgctaagcaaaactggactatggaaaactttatcgacactgaaataaacagaatcagaaaactggtcggtccaactgctgaagtcattggtgctgtttccggtggtgttgattctactgttgcatccaaattgatgacagaagccatcggtgatagattccatgccatcttggtcgataacggtgttttgagattaaatgaagctgctaacgttaaaaagacccttgtcgaaggtttaggtatcaacttgatggttgtcgatgcttccgaagaatttttaagtaaattgaagggtgtcactgacccagaaaagaagagaaagattattggtaacacatttatccacgtctttgaaagagaagctgaaaaaattaagccaaaagatggtaaggagattcaattcctgttacaaggtactctttatccagatgtcatcgaatccatttctttcaaaggtccttctcaaaccattaaaactcatcacaacgtcggtggtttactagagaacatgaaattaaagctaattgaaccattgagagaactgttcaaagacgaagtcaggcatctaggtgaattattaggaatccctcatgatctagtctggagacaccctttccctggtccaggtattgctattcgtgttctaggtgaagttactaaggaacaagtcgaaatagcaagaaaagctgacaacatttacattgaagaaatcaagaaggccggcttatacaaccaaatttcccaagcctttgcctgtttgttgcccgttaaatccgttggtgttatgggtgaccaaagaacctatgatcaagttattgctttgagggccattgaaactactgatttcatgactgctgactggttcccattcgaacacagtttcttgaagaaagtcgcctcaagaattgtcaatgaagtcgatggggttgctagggtcacttacgatataacttccaaacctcctgcaactgttgaatgggaatga

SEQ ID NO: 732 - DNA, 564 bp, Saccharomyces cerevisiae
atgtcccgtcctatcgtaatttctggcccaagtggtacaggtaaatctacactgttgaagaaattgttcgctgaatacccagattctttcgggtttagtgtttcatccactactagaaccccaagagctggcgaagtaaacggtaaggactataactttgtctccgtagatgaattcaaatctatgattaagaacaatgaattcattgaatgggcgcaattctccggtaactactatggtagtactgtcgcttccgtcaaacaagtcagtaaatctggtaagacttgtattttagatattgatatgcagggtgtcaaatctgtcaaggctatcccagagttaaatgccaggtttttgtttattgctccaccatcggtcgaggatttgaaaaaaagattagaaggtagaggtacggagaccgaagaatccatcaacaagaggttaagcgccgctcaagctgaattggcatatgctgagacaggtgcccatgacaaagttattgtcaatgatgatttggacaaggcctacaaggaattgaaggattttatctttgcagaaaaatga

SEQ ID NO: 733 - DNA, 732 bp, Saccharomyces cerevisiae
atgcataacatccaattagtgcaagagatagaaagacatgaaaccccgttaaacattagacctacctctccatacactttaaaccctcctgtcgagagagatgggttttcttggccaagtgtgggtacaagacaacgtgcagaggaaactgaagaggaggaaaaggaacgaattcaacgcatttcaggcgctatcaagacaattttgaccgaactgggtgaagatgtcaacagagaaggtctactagatactccacaaagatacgctaaagccatgctttatttcactaaaggttaccaaacgaacattatggacgatgtcattaagaatgctgtctttgaagaagatcatgatgaaatggttattgttcgtgatattgaaatttactcgttatgtgaacatcatttggtgccatttttcggcaaggttcatatcgggtatataccaaataaaaaagtcatcgggttaagtaagttggccagattggcagaaatgtatgcgagaaggctccaagttcaagaaagacttacaaagcaaattgcaatggccctaagtgatattctaaaaccattaggtgtagccgttgttatggaagcttctcatatgtgcatggtttcaagaggcattcaaaaaacgggatcttctacggtaacttcttgtatgcttggagggtttagggctcataaaacaagagaagagtttttaactcttttaggaagaagaagtatttga

SEQ ID NO: 734 - DNA, 2667 bp, Saccharomyces cerevisiae
atgtacgtttataaaagagacggtcgtaaagaacctgtccaattcgataagattaccgctcgtatatcacgcttatgctatggtttagatccaaaacatatcgacgccgttaaggtcacccaacgtatcatttctggtgtctatgaaggtgtcacaacaatcgaactagacaacttagccgctgaaacatgcgcttatatgactactgttcatccagattacgccaccctagcggccagaattgccatttctaatttacataaacaaaccacaaaacaattttctaaggttgtcgaagatctttatagatacgtcaatgctgctactggtaagcccgctcccatgatctctgatgatgtctacaatattgtcatggaaaacaaggataaattgaactccgcaattgtctatgacagagattttcagtacagttattttggttttaaaactttggaacgttcttatttactaagaatcaacggtcaagtggccgaacgtccacaacatttaattatgagagtcgcactaggcatccacggtagagatatcgaggctgctttagaaacgtataacttgatgtctctaaaatattttactcacgcctctccaacgttgttcaatgccggtactccaaaacctcaaatgtcctcttgtttcttggttgccatgaaggaggactctatcgaggggatttacgacaccttgaaggaatgtgctttgatttccaaaactgctggtggtattggtctacatatccataacattcgttcaactggttcttacattgctggtacaaacggtacttctaacggtttaattcctatgattcgtgttttcaataacactgcccgttatgttgaccagggtggtaataaaagacctggtgcgtttgccctttacctggaaccatggcatgctgatatatttgattttattgatattaggaagaaccacggtaaagaggaaattcgtgcaagagatttgttccctgctctatggattcctgatcttttcatgaagcgtgtcgaagaaaatgggacctggacattattctctccaacatcagctcctggtttaagcgattgttacggtgacgagtttgaggctctatatacccgctacgagaaagaaggtcgtggtaagactatcaaagcccaaaaattatggtattccattttggaagctcaaactgaaactggtacacctttcgttgtttacaaggatgcttgtaacagaaaatctaatcaaaaaaacttaggtgtcatcaagtcatcaaacttatgctgtgaaattgttgaatactcagctccagatgaaactgctgtttgtaacttggcttccgttgccttaccagcattcattgaaacttctgaggatggtaagacttccacatacaacttcaaaaaattacatgaaattgctaaagttgttactcgtaatttaaacagagtcattgatcgtaattactaccctgttgaagaagcgagaaaatccaatatgagacatagaccaattgctttgggtgttcaaggtctcgctgacactttcatgctgttacgtttgccatttgattctgaggaagcccgtttgctaaatatccaaatctttgaaactatttatcatgcctccatggaagcttcttgtgaactagctcagaaggacggtccatacgaaactttccaaggatctcctgcttctcaaggtatactacagtttgatatgtgggaccaaaaaccctacggcatgtgggattgggacaccttaagaaaagatatcatgaagcatggtgttagaaattccttgaccatggcaccaatgcctactgcatccacatcccaaatattgggttataatgaatgtttcgaaccagtcacttccaatatgtactcccgtcgtgtcttatccggtgaattccaggttgtgaacccttacttactgcgtgacttggttgatttaggtatttgggatgagggtatgaaacagtatctgattacacaaaatggctccattcaaggcttaccaaacgttccacaagaattgaaggacttatacaagactgtttgggaaatttcacaaaagactatcattaacatggcagccgatcgttctgtctatattgatcaatctcattctttgaatttgttcttacgtgccccaactatgggtaaactaacaagtatgcatttttacggatggaagaagggattgaagaccggtatgtactatttgagaacccaagctgcatctgctgcaattcaatttactattgatcagaagattgcggatcaagctacagaaaacgttgctgatatttccaacttgaagcgtccatcatatatgccttccagtgcaagctacgctgccagcgatttcgtgcccgcagctgtgactgcaaacgcaactattccatctctagatagctcctcggaagcttcaagagaggcatctccagctccaacaggtagccactcattaactaaaggaatggcagaattaaacgttcaagagtctaaggtagaagttcctgaagtacctgccccaactaagaatgaagaaaaagctgcccccatcgttgatgatgaggaaaccgagttcgacatttacaactctaaggttatagcatgtgctattgataacccagaagcttgtgaaatgtgttcgggttaa

SEQ ID NO: 735 - DNA, 1200 bp, Saccharomyces cerevisiae
atgcctaaagagaccccttccaaagctgctgccgatgcattgtccgacttggaaatcaaagattccaagtccaaccttaacaaggaattggagacattgagagaggaaaacagagtaaagtcagacatgcttaaggagaaattgagcaaggacgctgaaaatcacaaggcttacttgaaatctcatcaagttcaccgtcacaaacttaaggaaatggaaaaggaggaacctttgttgaatgaagacaaggagagaactgttcttttccctatcaagtaccatgaaatctggcaagcctacaagcgtgccgaagcttctttctggaccgctgaagaaattgatttgtctaaggatatccatgactggaacaacagaatgaacgaaaacgagagatttttcatttccagagttcttgcctttttcgccgcttctgacggtattgttaatgaaaacttggttgaaaacttctccaccgaagtccaaattccagaggcaaagagtttctacggtttccaaatcatgattgaaaatattcactctgaaacttactccttgttgatcgatacttacatcaaggaccctaaagaaagtgaattcttgttcaatgccattcacaccatcccagaaatcggtgagaaggccgaatgggctttaagatggattcaagacgctgacgccttgtttggtgaaagactagttgcctttgcctccattgaaggtgtctttttctccggttcctttgcctccattttctggttgaaaaagagaggtatgatgcccggtttaaccttttccaacgaattgatctgtagagacgaaggtttgcacaccgactttgcatgcttgttgttcgcccatttgaagaacaaaccagacccagccattgttgaaaaaattgtcaccgaggctgtggaaattgaacaaagatacttcttggacgccttaccagttgctttgctaggtatgaacgctgacttaatgaaccaatacgttgagttcgtcgccgacagactgttggttgctttcggtaacaagaaatactacaaggtcgaaaaccccttcgatttcatggaaaacatctccttggccggtaagaccaacttcttcgaaaagagagtttctgactaccaaaaggctggtgttatgtccaagtcgactaagcaagaagccggtgctttcaccttcaacgaagacttttaa

SEQ ID NO: 736 - DNA, 2610 bp, Saccharomyces cerevisiae
atgtacgttattaaaagagacggccgcaaagagcccgttcaattcgataaaattacctcccgtatcacccgtttgtcatacggtttagacccaaaccgtattgatgctgttaaggtaacccaacgtattatttctggtgtgtactccggtgttactaccgttgagctggacaatcttgcagctgaaacatgtgcatacatgaccactgtgcaccctgattatgccactctagccgctagaatcgccatctctaacttacataagcaaaccacaaagcaattctccaaagttattgaggatttacacgactggattaacccagctactggaaagcatgctcctatgatttcggacgaaatttacaacattgtcatggaaaacaaagatactttgaactcggccatcgtgtacgatagggatttccagtatacgtatttcggattcaagacactggagcgttcgtacttgctaagactgaacggtgaagtggcagaacgtcctcagcatttggtaatgcgtgtggcgctaggtatccatggtagcgatatcgaatctgtgctgaagacttataatttgatgtcgttaagatacttcactcacgcttccccaactttattcaacgctggtacgccacatcctcaaatgtcttcatgtttcttaattgccatgaaggatgactctatcgaaggtatttatgatactttgaaagaatgtgctatgatttccaaaactgcaggtggtgttggtcttcatatcaacaacatccgttccacaggttcttatatcgctggtaccaacggtacttcaaacgggttgattcctatgattcgtgttttcaataatactgcccgttatgtggaccagggtggtaacaagagacctggtgctttcgcccttttcttggagccatggcatgcagatatcttcgactttgtcgatatcagaaaaacacatggtaaggaagaaattcgtgcaagagatttgttccctgctctatggatccctgatcttttcatgaaacgtgttcaagaggatgggccttggactttgttttcgcccagtgctgccccaggtttagatgatgtgtggggtgatgaatttgaagaactatatactcgttacgaaagagaaggtcgtggtaaaacaattaaagcccaaaagttgtggtatgccattttgcaagcacagacagaaacaggtacacctttcatggtttataaggacgcatgtaacaggaagacaaaccaacagaacttaggtactatcaaatcatctaatttatgttgtgaaatcgtcgaatattcctccccggatgaaactgcagtttgtaatttagcttctattgccctaccagcattcgttgaggtttcagaagatggtaaaactgcaagctataatttcgagagattacacgagattgctaaagtcattactcacaacttgaacagagttatcgaccgtaattactatccagttcccgaggctagaaattcaaatatgaagcatagacctattgctcttggtgtccagggtttggccgatacttatatgatgttgcgtctaccctttgaatcggaagaagctcaaactctaaacaaacaaatcttcgaaactatttaccatgctactcttgaagcctcctgtgaattggcccaaaaagaaggtaaatattctacttttgaaggttctccagcttctaagggtattttacaattcgatatgtggaacgctaaaccatttggcatgtgggattgggaaaccttaagaaaggacattgttaaacatgggttaagaaactctttgactatggcaccaatgccaaccgcctcaacttcccaaattcttggttataatgaatgcttcgaaccagtgacctcaaacatgtactctcgtcgtgtcctgtctggtgaattccaagttgttaatccatatttactacgtgatttagtcgacctgggtatttgggatgatagtatgaaacaatatctaattacacaaaatggttctattcaaggcttaccaaatgtgccacaagaattgaaggaattatacaaaaccgtctgggaaatctctcaaaagaccattatcaatatggctgctgatcgtgccatctacatcgatcagtctcattccttgaatcttttcttgcaagcaccatcaatgggtaagattactagtatgcatttctacggttggaagaagggtttaaaaactggtatgtactacttaagaacgcaagccgcctccgctgctattcaatttaccattgatcaagaggttgccgatcaagccgctacacatattgcttccgtctcagaattggatcgtccagtttatgttccaaagggtacaaaattctctgaacaaaaggcggcatctgcgcttaccgaaagctcagataatgagaaggatgcatctccagttccatccgaacaatcatcggtgtcgagtgccatgtcaaatgtgaaattggaagatagtgttgccccagcagttccaacggaaacaataaaagaagattccgacgagaagaaatgtgacatttacaatgaaaaggtgattgcttgtactgctcctactccagaagcttgtgagtcatgttccggttga

SEQ ID NO: 737 - DNA, 1038 bp, Saccharomyces cerevisiae
atggaagcacataaccaatttttgaagactttccaaaaagaacgtcatgatatgaaagaagctgaaaaggatgaaatccttttgatggaaaacagccgtagattcgtgatgttccctatcaaataccacgaaatctgggctgcttacaagaaggttgaagcctctttctggactgcggaagaaatcgaattggctaaggacactgaagatttccaaaaattgactgatgaccagaagacctacatcggtaacttgttagccttgtccatttcttctgacaaccttgtcaacaagtacttgatcgaaaacttttctgcccaattgcaaaaccctgaaggtaagagtttctacgggttccagattatgatggaaaacatctactctgaagtttactccatgatggttgatgccttcttcaaggaccctaagaacatccctctattcaaggaaattgccaatttgcctgaagtcaagcataaggctgctttcatcgagagatggatttccaacgatgacagcttgtatgctgaaagactagtagcatttgctgcaaaggaaggtattttccaagctggtaactatgcttctatgttctggttgactgacaaaaagattatgccaggtttagcaatggccaacagaaacatctgtagagacagaggtgcctacactgacttttcatgcttgctatttgcccatttgagaaccaagccaaaccccaagatcattgaaaaaatcattaccgaagccgtggaaattgaaaaggaatactactcaaactctttgccagtagaaaaatttggtatggatttgaagagcattcacacctacatagaatttgtcgctgacggtctattacaaggtttcggtaacgaaaaatactacaacgccgtcaacccattcgaattcatggaggatgtcgctaccgctggtaagaccaccttctttgaaaagaaggtttccgactaccaaaaggccagtgacatgtctaagtccgctaccccatccaaggaaattaactttgatgatgacttctaa

SEQ ID NO: 738 - DNA, 462 bp, Saccharomyces cerevisiae
atgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatga

SEQ ID NO: 739 - DNA, 1302 bp, Saccharomyces cerevisiae
atggttaacgttgtattgggctcccaatggggtgatgagggtaaaggtaaactagttgatttactggttggtaaatatgatattgtagcccgttgcgccggtggtaacaatgccgggcataccattgttgtagacggtgttaagtatgatttccatatgttaccatctggtttagtcaacccaaactgccaaaaccttttgggtaatggtgttgttattcatgttccatcttttttcaaagagttggaaaccttggaagctaaaggtttgaagaacgcaaggagtagattatttgtttcttccagagcacatttagtctttgactttcatcaggtgactgacaagctaagagaattggagttatcaggtcgttctaaagatggtaaaaatatcggtactaccggtaaaggtattggtccaacttattccacaaaggcttctagatctggtttgagagttcatcatttggtgaatgatcaacccggtgcctgggaggaatttgttgctagatataagagattattggaaacgagaagacaaagatacggtgatttcgaatacgactttgaagccaagcttgctgaatacaagaagttaagagagcaactaaagccattcgtcgtcgattctgtcgttttcatgcacaatgctattgaagcaaagaaaaagatattggttgagggtgctaatgctttgatgttggatattgattttggtacttatccatatgtgacttcttccaatactggtattggtggtgtcctcaccggtttaggtattcctccacgtactattgatgaaatttatggtgttgttaaagcctacacaactagagttggtgaaggtcctttcccaacggaacaattgaacgaaaatggagaaaaactgcagaccattggtgctgaatttggtgtcactactggtcgtaagcgtcgttgcggttggttagacttggtagtcttgaaatactcaactttgatcaatggatacacgagtttgaacattaccaagttagacgtcctcgatactttcaaagaaatcccagtgggtatttcatattctattcaaggtaagaagctagatttgttccctgaagacttgaatattcttggtaaagttgaagttgaatacaaagttttgccaggttgggatcaagatattaccaaaattacaaagtatgaagatttgccggaaaacgcaaagaagtacttaaaatatattgaagattttgttggcgttcctgttgaatgggttggtaccggccccgcaagagaaagcatgttgcataaagaaattaaatag

SEQ ID NO: 740 - DNA, 669 bp, Saccharomyces cerevisiae
atgtctagctcagaatccattagaatggtcctaattggcccacctggtgccggtaaaggtactcaagctccaaatttgcaagagcgtttccatgccgctcacttggccactggtgacatgttgagatctcaaatcgcaaagggcactcaattaggtttggaagcaaagaaaattatggaccaaggtggtttagtctctgatgacattatggttaacatgatcaaggatgaattgaccaacaatccagcttgtaagaatgggttcatcttggacggtttcccaagaaccattcctcaggctgaaaaattggaccaaatgttgaaagaacaaggaactcctttggaaaaagccatcgaattgaaggttgatgatgaattgttggttgccagaattaccggtagattaattcacccagcctctggcagatcctaccacaagatctttaacccaccaaaggaagacatgaaggatgacgtcaccggtgaagctttagttcaaagatctgatgacaatgcagacgccttgaagaagagattagctgcttaccatgctcaaaccgaaccaattgttgacttttacaaaaagaccggtatctgggctggtgttgatgcttcccaacctcctgctactgtttgggctgacatcttgaacaagctaggtaaggattaa

SEQ ID NO: 741 - DNA, 678 bp, Saccharomyces cerevisiae
atgaaagcagacgcgaaacaaataacacatctactcaaacctcttcgacttttattattgggggctccagggtcaggtaaagggacacagacttcgagattactaaagcaaattccacaattatcttcaatttcgtcaggcgacattttacgtcaggaaataaaatctgaatctaccctaggccgagaggctactacctacattgctcaaggcaagttattaccggatgatctcataacgcgtctgataacttttcgtctttcggcattgggttggttaaaaccatctgccatgtggttgctcgatggatttcctcgaactactgcgcaagcttctgccttagacgagctgctgaaacagcatgacgccagcttgaatctagtggtagagctagatgtacccgaatccaccatattagaaaggatcgagaacagatatgttcacgttcctagtgggagagtgtataacttacaatataatcctcccaaagtgccaggattagacgatatcaccggagaaccattgaccaagaggcttgatgacacagcggaagtgtttaaaaaaaggctagaagagtacaagaaaacaaatgagcctttaaaagattattacaaaaaaagtgggatttttggtaccgtctctggggaaacatcagatattatcttccgaaattattga

SEQ ID NO: 742 - DNA, 6645 bp, Saccharomyces cerevisiae; identical to SEQ ID NO: 675

SEQ ID NO: 743 - DNA, 1095 bp, Saccharomyces cerevisiae
atggtacaagaaatcgatttaggtttgacatgtgatatgcatgttcatgtaagagagggtgcgatgtgtgaactagtcacccccaagattagagatggtggggtttcaattgcttacatcatgccaaatttacaacctccaattaccacactagatagagtgattgaatacaaaaagacactgcagaaactagctcctaaaactaccttcttaatgagtttttatctttcaaaagacttaactccagatttaattcatgaagctgcccaacaacatgccattcgtggagtaaagtgttatccagcgggagtaacaacaaattcggctgctggggtggatccaaatgacttcagcgcattttacccaattttcaaggctatgcaagaagagaacctggtattaaatttgcatggggaaaaaccttctgtccatgatggagacaaagaacctattcatgtattgaatgcagaggaagcctttttgccagccttgaaaaaattgcataatgatttcccaaacctgaaaataattctggaacactgcactagcgagtcggcaataaagacaatcgaggatataaataagaacgtgaagaaagccactgacgtaaaggttgctgccacattaacggctcatcacttatttttaacaattgatgattgggccggaaatccggtaaatttttgcaaacctgttgcgaaacttccaaatgacaaaaaggctctagtcaaagctgctgtatcagggaaaccatattttttctttggatctgattcagcacctcatcctgtacaaaataaggccaattacgagggtgtttgcgcaggagtttactcacaatcttttgcgatcccttatatcgcccaagtttttgaagagcaaaatgccttggagaacttaaagggctttgtttccgacttcggaatttccttttatgaggttaaagatagcgaagtggcttcttcagataaggcaatattattcaaaaaagaacaagttatccctcaggttatcagcgatggcaaagacataagcatcatcccatttaaagcaggtgataaactaagttggtcggtgagatgggaacctcgttaa

SEQ ID NO: 744 - DNA, 945 bp, Saccharomyces cerevisiae
atgacagccagtttaactaccaagttcttgaacaatacctatgaaaacccatttatgaatgcatccggtgttcattgcatgactacacaagaattagatgaattagcaaactctaaagctggcgcattcattacaaagagtgctacaaccttagaaagagaaggtaaccctgaaccacgttacatttctgtccctctaggcagtatcaactccatgggtttaccaaacgaaggtatcgactactatttgtcctatgtattaaaccgtcaaaagaattatcctgatgcacctgctattttcttctcagttgctggtatgagcattgatgaaaatttaaatttgttgaggaaaatccaagatagcgaattcaacggtattaccgagttaaacttgtcttgtcctaatgtgcctgggaaaccacaagttgcttatgactttgacttgacaaaggaaaccttggaaaaggtttttgcctttttcaaaaaacctcttggtgtcaagttgcctccttattttgattttgcccattttgatatcatggcaaaaatattgaacgagttcccattagcttatgtcaactctatcaatagtataggaaatggtcttttcattgatgtggagaaggagagtgtagtagtgaagccaaagaatggtttcgggggtattggaggtgaatatgttaagccaaccgcgctcgccaatgttcgtgcattttacactcgtttgagacctgaaatcaaagttatcggtacaggtggaattaagtccggtaaggatgcatttgaacatcttctatgtggtgcctctatgctacagattggtacagaattacaaaaagagggcgtcaagatttttgaacgtatcgaaaaagaattaaaagacataatggaagctaagggttatacatccatagatcagttccgtgggaagttgaacagcatttaa

SEQ ID NO: 745 - DNA, 681 bp, Saccharomyces cerevisiae
atgcctattatgttggaagactaccaaaagaactttctagagttggccatcgaatgccaggctctaagatttggttcattcaagttgaaatcaggtagagaatcgccatatttctttaatttgggattgttcaatactggtaaattgctttccaatttggctactgcgtatgcaattgccatcatacaatctgatttgaaatttgatgtgattttcggtcctgcctacaaaggtatcccacttgctgctattgtttgtgtgaaattggcggagattggtggctctaaatttcaaaacattcagtacgcttttaacagaaaggaagccaaagatcatggtgaaggtggtatcattgtcggctctgccctagagaacaagagaatattaatcatcgacgacgtcatgactgctggtactgccattaacgaggcctttgagatcatcagtaacgccaagggtcaggtagttggctccataattgctcttgatagacaggaagttgtgagtactgacgataaagaaggactcagcgccactcaaactgttagcaaaaaatacggtatcccagtcttgagcattgtctccttaattcacataattacctatttggaaggcagaataacagcagaagagaaaagcaagatcgaacaataccttcaaacctacggtgcctccgcttaa

SEQ ID NO: 746 - DNA, 684 bp, Saccharomyces cerevisiae
atgtctgcatctactacaagtttagaggaatatcaaaaaactttccttgaactgggattagaatgcaaagcactaagatttgggtcattcaagctgaattcaggcaggcagtcgccatattttttcaatcttagtttgttcaattctggaaagctgttggcaaaccttgccaccgcgtatgcaactgctatcattcaatcggagcttaaattcgatgttattttcggacctgcttacaaagggatccctttggctgctattgtatgcgttaaactagcagaaatcgggggcactaaatttcaaggtattcaatatgcttttaatagaaagaaagttaaagaccacggcgaaggtggtattattgttggagcatcgcttgaagacaagagggtgttgattatcgacgatgtcatgactgcaggaactgcaatcaatgaagcatttgagataatcagtattgctcaaggtagggtagtgggttgtattgttgctttagataggcaagaagtgattcatgaatctgatccggaaagaacaagtgctacccaatctgtttcaaagagatacaacgttcctgtgctaagtattgtatcactgactcaagtggtacaatttatgggaaatagactatcaccagagcaaaaatcagcgattgaaaactaccgtaaggcctatggtatatga

SEQ ID NO: 747 - DNA, 804 bp, Saccharomyces cerevisiae
atgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaa

SEQ ID NO: 748 - DNA, 615 bp, Saccharomyces cerevisiae
atgacagctgccactacatcacagccagctttctcgcctgaccaagtttccgtgatcttcgttctaggaggacccggtgcaggcaagggtactcagtgtgaaaaactagttaaggactattcatttgtccatttgtcagccggagaccttctacgtgctgagcagggcagagcaggttcccaatatggggaattgatcaagaactgcatcaaagagggccagattgtccctcaagagattactttggcgcttttacgcaacgctatttccgataacgtcaaggcgaacaagcataagttcttaattgacggatttcctaggaagatggatcaagccatttcctttgaaagagacatcgttgaaagcaaattcatcctgttctttgactgccctgaagatatcatgttagagagactattggagcgtggcaagaccagtggtagaagcgatgacaacattgagtccattaagaagagatttaacactttcaaggagactagtatgcccgtcatcgagtactttgaaaccaaatcgaaagtcgtccgtgttcgttgcgacagatccgtcgaagatgtgtacaaagacgtccaagacgctatccgtgatagcttatag

SEQ ID NO: 749 - DNA, 1740 bp, Saccharomyces cerevisiae
atgaagtacgttgttgtttcaggtggtgtcatttcgggtatcggtaaaggtgttcttgcatcttcaactggtatgctaatgaaaaccctcggtttaaaggttacgtcaattaaaattgacccttatatgaacattgatgcaggtactatgtctcctttggaacatggtgaatgtttcgtgcttgacgacggtggtgaaacagatttggacttgggtaactacgagagataccttggagttactttgactaaagatcataacattactactggtaaaatatactcgcacgttattgctaaggaaagaaaaggtgactatttaggcaaaaccgtgcaaattgtccctcatttgaccaacgctatccaagattggattgagcgcgtggccaaaattcctgtagatgacaccggtatggaaccagatgtttgtatcattgaattgggtgggacagttggtgacattgaaagtgctccttttgtggaggcactaagacaattccaatttaaagttggaaaggaaaattttgccttgatacacgtttctctagttcctgtcatccacggtgaacaaaaaactaagccaactcaagctgccatcaaaggtttgaggtctcttggtttagttccagatatgatcgcctgtagatgtagtgaaactttggataaaccaacaatcgataagattgccatgttttgtcatgtggggcctgaacaggtggttaacgttcacgatgttaattctacttatcacgtcccattgttgctactggaacaaaagatgattgattacttacacgccagattaaagttagatgaaatatcacttacagaagaagaaaaacaaagaggcctggaattattgtctaaatggaaggccacaacaggtaacttcgatgaatccatggaaacagtgaagattgctttggttgggaaatacaccaacttgaaagattcttatctatcagtgataaaagcattggaacattcatccatgaagtgtcgtcgtaagttagacattaaatgggtggaagctactgatttggaacctgaagcacaagaaagcaacaaaactaaatttcatgaagcatggaacatggtcagtaccgcagacggtatcttaatccccggtggttttggtgttagaggtactgaaggtatggttttggctgctagatgggctcgtgaaaatcacattccattcttaggggtttgcctgggtttacaaattgccaccattgaatttacacgtagtgtgttgggaagaaaagacagtcattcggcagaattttatccagacattgatgaaaaaaatcacgttgtcgttttcatgcctgaaattgacaaggaaaccatggggggctcaatgagattaggtttgagaccaacatttttccaaaatgaaactgaatggagtcaaatcaagaagttatacggtgacgtctccgaagtccatgaaagacaccgtcaccgttacgaaatcaatccaaagatggttgatgaattggaaaacaacgggttgatctttgtaggtaaggacgacactggaaagcgttgtgagattttggaattaaagaatcacccatactatattgctactcaatatcacccagaatacacatcaaaggtcttagatccatccaaaccatttttgggtttagttgctgcttccgctggtatccttcaagatgtcattgaaggtaagtacgatcttgaggccggcgaaaacaaattcaacttttaa

SEQ ID NO: 750 - DNA, 1086 bp, Saccharomyces cerevisiae
atgatttctgctaattcattacttatttccactttgtgcgcttttgcgatcgcaacacctttgtcaaaaagagattcctgtaccctaacaggatcttctttgtcttcactctcaaccgtgaaaaaatgtagcagcatcgttattaaagacttaactgtcccagctggacagactttagatttaactgggttaagcagtggtactactgttacgtttgaaggcacaaccacatttcagtacaaggaatggagcggccctttaatttcaatctcagggtctaaaatcagcgttgttggtgcttcgggacataccattgatggtcaaggagcaaaatggtgggatggcttaggtgatagcggtaaagtcaaaccgaagtttgtaaagttggcgttgacgggaacatctaaggtcaccggattgaatattaaaaatgctccacaccaagtcttcagcatcaataaatgttcagatttaaccatcagcgacataacaattgatatcagagacggtgattcggctggtggtcataatacggatgggtttgatgttggtagttctagtaacgtcttaattcaaggatgtactgtttataatcaggatgactgtattgctgtgaattccggttcaactattaaatttatgaacaactactgctacaatggccatggtatttctgtaggttctgttggtggccgttctgataatacagtcaatggtttctgggctgaaaataaccatgttatcaactctgacaacgggttgagaataaaaaccgtagaaggtgcgacaggcacagtcactaatgtcaactttatcagtaataaaattagcggcataaaaagttatggtattgttatcgaaggcgattatttgaatagtaagactactggaactgctacaggtggcgttcccatttcgaatttagtaatgaaggatatcaccgggagcgtgaactccacagcgaagagggttaaaattttggtgaaaaacgctactaactggcaatggtctggggtgtcaattaccggtggttcttcctattctggatgttctggaatcccatctggatctggtgcaagctgttaa

SEQ ID NO: 751 - DNA, 747 bp, Saccharomyces cerevisiae
atggctagaactttctttgtcggtggtaactttaaattaaacggttccaaacaatccattaaggaaattgttgaaagattgaacactgcttctatcccagaaaatgtcgaagttgttatctgtcctccagctacctacttagactactctgtctctttggttaagaagccacaagtcactgtcggtgctcaaaacgcctacttgaaggcttctggtgctttcaccggtgaaaactccgttgaccaaatcaaggatgttggtgctaagtgggttattttgggtcactccgaaagaagatcttacttccacgaagatgacaagttcattgctgacaagaccaagttcgctttaggtcaaggtgtcggtgtcatcttgtgtatcggtgaaactttggaagaaaagaaggccggtaagactttggatgttgttgaaagacaattgaacgctgtcttggaagaagttaaggactggactaacgtcgttgtcgcttacgaaccagtctgggccattggtaccggtttggctgctactccagaagatgctcaagatattcacgcttccatcagaaagttcttggcttccaagttgggtgacaaggctgccagcgaattgagaatcttatacggtggttccgctaacggtagcaacgccgttaccttcaaggacaaggctgatgtcgatggtttcttggtcggtggtgcttctttgaagccagaatttgttgatatcatcaactctagaaactaa

SEQ ID NO: 752 - DNA, 2043 bp, Saccharomyces cerevisiae
atgactcaattcactgacattgataagctagccgtctccaccataagaattttggctgtggacaccgtatccaaggccaactcaggtcacccaggtgctccattgggtatggcaccagctgcacacgttctatggagtcaaatgcgcatgaacccaaccaacccagactggatcaacagagatagatttgtcttgtctaacggtcacgcggtcgctttgttgtattctatgctacatttgactggttacgatctgtctattgaagacttgaaacagttcagacagttgggttccagaacaccaggtcatcctgaatttgagttgccaggtgttgaagttactaccggtccattaggtcaaggtatctccaacgctgttggtatggccatggctcaagctaacctggctgccacttacaacaagccgggctttaccttgtctgacaactacacctatgttttcttgggtgacggttgtttgcaagaaggtatttcttcagaagcttcctccttggctggtcatttgaaattgggtaacttgattgccatctacgatgacaacaagatcactatcgatggtgctaccagtatctcattcgatgaagatgttgctaagagatacgaagcctacggttgggaagttttgtacgtagaaaatggtaacgaagatctagccggtattgccaaggctattgctcaagctaagttatccaaggacaaaccaactttgatcaaaatgaccacaaccattggttacggttccttgcatgccggctctcactctgtgcacggtgccccattgaaagcagatgatgttaaacaactaaagagcaaattcggtttcaacccagacaagtcctttgttgttccacaagaagtttacgaccactaccaaaagacaattttaaagccaggtgtcgaagccaacaacaagtggaacaagttgttcagcgaataccaaaagaaattcccagaattaggtgctgaattggctagaagattgagcggccaactacccgcaaattgggaatctaagttgccaacttacaccgccaaggactctgccgtggccactagaaaattatcagaaactgttcttgaggatgtttacaatcaattgccagagttgattggtggttctgccgatttaacaccttctaacttgaccagatggaaggaagcccttgacttccaacctccttcttccggttcaggtaactactctggtagatacattaggtacggtattagagaacacgctatgggtgccataatgaacggtatttcagctttcggtgccaactacaaaccatacggtggtactttcttgaacttcgtttcttatgctgctggtgccgttagattgtccgctttgtctggccacccagttatttgggttgctacacatgactctatcggtgtcggtgaagatggtccaacacatcaacctattgaaactttagcacacttcagatccctaccaaacattcaagtttggagaccagctgatggtaacgaagtttctgccgcctacaagaactctttagaatccaagcatactccaagtatcattgctttgtccagacaaaacttgccacaattggaaggtagctctattgaaagcgcttctaagggtggttacgtactacaagatgttgctaacccagatattattttagtggctactggttccgaagtgtctttgagtgttgaagctgctaagactttggccgcaaagaacatcaaggctcgtgttgtttctctaccagatttcttcacttttgacaaacaacccctagaatacagactatcagtcttaccagacaacgttccaatcatgtctgttgaagttttggctaccacatgttggggcaaatacgctcatcaatccttcggtattgacagatttggtgcctccggtaaggcaccagaagtcttcaagttcttcggtttcaccccagaaggtgttgctgaaagagctcaaaagaccattgcattctataagggtgacaagctaatttctcctttgaaaaaagctttctaa

SEQ ID NO: 753 - DNA, 2046 bp, Saccharomyces cerevisiae
atggcacagttctccgacattgataaacttgcggtttccactttaagattactttccgttgaccaggtggaaagcgcacaatctggccacccaggtgcaccactaggattggcaccagttgcccatgtaattttcaagcaactgcgctgtaaccctaacaatgaacattggatcaatagagacaggtttgttctgtcgaacggtcactcatgcgctcttctgtactcaatgctccatctattaggatacgattactctatcgaggacttgagacaatttagacaagtaaactcaaggacaccgggtcatccagaattccactcagcgggagtggaaatcacttccggtccgctaggccagggtatctcaaatgctgttggtatggcaatagcgcaggccaactttgccgccacttataacgaggatggctttcccatttccgactcatatacgtttgctattgtaggggatggttgcttacaagagggtgtttcttcggagacctcttccttagcgggacatctgcaattgggtaacttgattacgttttatgacagtaatagcatttccattgacggtaaaacctcgtactcgttcgacgaagatgttttgaagcgatacgaggcatatggttgggaagtcatggaagtcgataaaggagacgacgatatggaatccatttctagcgctttggaaaaggcaaaactatcgaaggacaagccaaccataatcaaggtaactactacaattggatttgggtccctacaacagggtactgctggtgttcatgggtccgctttgaaggcagatgatgttaaacagttgaagaagaggtgggggtttgacccaaataaatcatttgtagtacctcaagaggtgtacgattattataagaagactgttgtggaacccggtcaaaaacttaatgaggaatgggataggatgtttgaagaatacaaaaccaaatttcccgagaagggtaaagaattgcaaagaagattgaatggtgagttaccggaaggttgggaaaagcatttaccgaagtttactccggacgacgatgctctggcaacaagaaagacatcccagcaggtgctgacgaacatggtccaagttttgcctgaattgatcggtggttctgccgatttgacaccttcgaatctgacaaggtgggaaggcgcggtagatttccaacctcccattacccaactaggtaactatgcaggaaggtacattagatacggtgtgagggaacacggaatgggtgccattatgaacggtatctctgcctttggtgcaaactacaagccttacggtggtacctttttgaacttcgtctcttatgctgcaggagccgttaggttagccgccttgtctggtaatccagtcatttgggttgcaacacatgactctatcgggcttggtgaggatggtccaacgcaccaacctattgaaactctggctcacttgagggctattccaaacatgcatgtatggagacctgctgatggtaacgaaacttctgctgcgtattattctgctatcaaatctggtcgaacaccatctgttgtggctttatcacgacagaatcttcctcaattggagcattcctcttttgaaaaagccttgaagggtggctatgtgatccatgacgtggagaatcctgatattatcctggtgtcaacaggatcagaagtctccatttctatagatgcagccaaaaaattgtacgatactaaaaaaatcaaagcaagagttgtttccctgccagacttttatacttttgacaggcaaagtgaagaatacagattctctgttctaccagacggtgttccgatcatgtcctttgaagtattggctacttcaagctggggtaagtatgctcatcaatcgttcggactcgacgaatttggtcgttcaggcaaggggcctgaaatttacaaattgttcgatttcacagcggacggtgttgcgtcaagggctgaaaagacaatcaattactacaaaggaaagcagttgctttctcctatgggaagagctttctaa

SEQ ID NO: 754 - DNA, 1500 bp, Saccharomyces cerevisiae; identical to SEQ ID NO: 624

SEQ ID NO: 755 - DNA, 3045 bp, Saccharomyces cerevisiae
atgctaaggttcgtgtcttcgcaaacctgccggtatagttcaagaggactattaaaaacatctttacttaaaaatgcatctactgtcaaaattgtcggaagagggttagccaccactggtacagataattttctatcgacatcaaatgccacctatatcgatgaaatgtaccaagcttggcaaaaagacccatcttcagtccatgtttcatgggacgcatatttcaagaatatgtctaacccaaagattccagctacaaaggcttttcaggctcctcccagtatcagtaactttccccagggtaccgaagcagctcccttagggaccgcaatgactggttcagtagatgagaacgtctccattcatctaaaagtgcaattgctatgtagagcttaccaagttagaggtcatttaaaagcccatatagatcctttagggatctcatttggtagtaataaaaataaccctgttcctccggaattgactctagactactacggctttagcaaacacgatcttgataaagaaatcaacctaggacctggtatcctgccaaggtttgcaagggacgggaaatctaaaatgtctctgaaagagattgtggatcatctagaaaagttatattgttcctcttatggggtacaatacacacatattccatctaagcaaaagtgtgattggttaagagagagaattgagattcctgaaccttaccaatatacagtggaccaaaagagacaaatcttagatagattaacatgggccacttcttttgagtcattcttatctacaaaatttccaaatgataagaggttcggtttagaaggtttggaaagtgttgttccaggtattaaaactttggttgatcgttctgttgaattgggtgtagaagatattgttttgggtatggctcaccgtggtagattgaacgttttatccaatgtggtccgtaaaccaaatgaatctattttttctgaatttaagggttcgagcgctcgcgatgatattgaaggatcgggtgatgtcaagtaccatttgggtatgaactaccaaagaccaactacgtctggtaagtacgtcaatttatcgctggtggcaaatccttctcatttagaatcccaagatccagttgttcttggtagaactagagctttattgcatgccaagaacgatttgaaggaaaaaacaaaggccttaggtgtgttattacatggtgatgctgcttttgctgggcagggtgttgtttatgaaaccatgggtttcttgaccctaccagaatactctactggtggtactattcatgttattacaaacaaccagatcggattcactacggatccaagatttgcaaggtccacaccatatccttccgatttggctaaggccattgatgccccaattttccatgttaacgctaatgacgtggaagctgtgacctttattttcaatttagccgcagaatggagacataagttccacacagatgccataattgatgtcgttggttggagaaaacatggacataatgaaaccgatcagccatcgtttactcaaccattaatgtacaaaaaaattgcaaaacaaaaatctgtcattgacgtctatacggaaaaattgataagtgaaggcacattttctaaaaaagatattgatgagcacaagaaatgggtatggaacttatttgaagatgctttcgaaaaggcaaaggattacgtcccatctcaaagagaatggttaactgctgcctgggaaggattcaaatccccaaaggaattggccactgagatattaccacatgaaccaactaatgttccagagagtactttgaaagaactaggtaaggtactctcttcgtggccagaaggttttgaagtgcacaaaaatctaaagagaattttgaaaaatagaggaaaatctattgagacaggtgaaggcatcgattgggccaccggtgaagcattagcgttcggtacattggttttggatggtcagaacgttagggtttccggtgaagatgtagaaagaggtacattttctcaacgtcatgcagtcttgcatgaccaacaatctgaagccatttacacaccgctaagcactctgaataatgaaaaggcagacttcaccattgcaaattcctcgttatctgagtacggtgtaatgggtttcgaatatggttattcgctaacctccccagattatctagtcatgtgggaggctcaattcggtgactttgcaaatacagcacaggttattattgaccaatttattgccggtggtgaacaaaaatggaagcaacgctctggtttagttttgtctttaccccatggttatgatggccaggggccagaacattcgtctggtagattggaaagattcttgcaactagccaatgaagacccaagatatttcccatctgaagaaaagctacagagacaacatcaggattgtaatttccaggttgtttatccaactacgcctgctaatttattccacattctaaggagacagcaacatcgtcaattccgtaaaccattggcgttattcttttctaaacagctgctgcgtcacccattggccagatcatctctttccgaattcactgaaggcggattccaatggattatcgaagatattgaacatggaaaaagtattggtacgaaagaggaaaccaagagattagttttgctgagtggccaagtgtacactgccctacataaaagacgtgaaagtttgggtgataagaccactgctttcttaaagattgaacagctgcacccattcccatttgctcagctacgtgattcattaaattcttatccaaacttggaagaaattgtttggtgccaggaagagccattgaacatgggttcgtgggcatacacagaaccacgcttacacacaacattaaaagaaacggataaatataaggatttcaaggtcagatactgtggtagaaacccaagtggtgctgttgctgccggtagcaaatcactacatttggccgaagaagatgcctttttgaaagatgttttccaacaatcctaa

SEQ ID NO: 756 - DNA, 1392 bp, Saccharomyces cerevisiae
atgctttccagagcgacgcgtactgcagctgccaaatccttagtaaaatctaaagtggctagaaatgttatggctgcttctttcgtcaagagacatgcttctacaagtttgttcaaacaagctaacaaggtcgaatccttaggttcaatatatttatccggcaagaaaatttcagttgcggcgaatccgttctccataactagcaatcgttttaaatctacctctattgaagttcctccgatggcagagtccctgactgaaggctctttaaaggaatatactaaaaacgttggtgattttattaaggaggacgagctgttggccactattgagaccgataaaattgatattgaggtcaattcgccagtatcaggtactgttacgaagctaaatttcaaaccagaggacactgtcactgttggtgaggagttagctcaggtcgagcctggtgaagcacctgctgagggttctggagaatctaagccagagcctaccgaacaagcggagccatcgcaaggtgtcgccgcaagggaaaactcaagtgaggaaacggcttcaaagaaagaagctgctccaaagaaagaagccgctccaaagaaagaagttacagaaccaaaaaaggctgatcaaccaaagaagaccgtctctaaggcgcaggaacccccagtagcctctaactctttcacaccatttccacgtacagaaaccagggtcaaaatgaaccgtatgagattgaggattgccgaaagattaaaagagtctcaaaacactgctgcttccttaaccacattcaacgaagttgacatgtcagctttgatggaaatgaggaaactgtataaagatgagattattaagaagaccggtactaaattcggattcatgggtcttttctccaaagcatgtaccttggccgccaaggatattccagccgtcaatggtgccattgaaggtgaccagattgtttatcgtgattacacagatatttctgttgctgtggccactccaaagggtttggttacccccgtcgttcgtaatgcagagtcattgagtgttttagatattgagaacgaaattgttcgcttgagtcataaagcgcgtgatggcaaattaaccctagaagatatgacgggtggtactttcaccatatctaatggtggtgtttttggttcattatacggtactcctatcatcaattcaccacaaacagccgtcctaggcttgcatggtgtcaaagagagacctgtcactgttaatggacaaattgtctcaagaccaatgatgtacttggctttgacttatgatcatagattgctagatggtagagaagctgttaccttcttgaagactgttaaagagttgattgaagaccctagaaaaatgttgttatggtga

SEQ ID NO: 757 - DNA, 1521 bp, Saccharomyces cerevisiae
atgccagagtccagattgcagagactagctaatttgaaaataggaactccgcagcagctcagacgcacctccataataggtaccattgggcccaagacaaatagctgcgaggccattactgctctgagaaaagctggtttgaacatcattcgattgaacttttcccatggctcctacgaattccatcaatcagtaatcgaaaatgctgtgaaatcggaacagcaattccctggcaggccgctcgccattgccctggataccaagggtcccgagatcagaacaggtcgcacgttaaatgaccaagatctttatatccccgtagaccaccaaatgatctttaccactgacgcaagttttgcaaacacctccaatgataaaatcatgtatatagactatgctaacctgacaaaagttatcgttccggggagatttatatacgtggacgacgggattctctcttttaaagtgctccaaatcattgacgaatctaatttaagggtgcaagcggtaaactcgggttatatcgcatctcataaaggtgttaatctgcctaataccgacgttgatttgccccccttgtccgccaaagacatgaaggacttgcaattcggagtccgcaatggcattcacatcgtatttgcctctttcataagaacttcagaagatgtgttgtctatcagaaaagcgttgggttctgaagggcaagatatcaagattatatccaagatagaaaaccagcaagggttggataattttgacgaaatcctggaagtcacggatggtgttatgatagcgagaggcgatttaggaattgaaatcctggcacctgaagtattagccattcaaaaaaagctgattgcaaaatgtaatttggcgggcaaacctgtcatttgcgcgactcagatgctggattcaatgacacacaatccgagaccgacaagggctgaagtatcggatgtgggtaacgctgtgttggatggtgctgattgtgttatgctttctggagaaacggcgaagggtgattatccggtgaatgcagttaatattatggcggcgaccgctctgattgctgaaagtactatcgctcatttggctctttatgacgatctcagagacgccactcccaaacctacttccactacggaaactgtagcagctgcagctaccgcagcaatcttggagcaagatggtaaggccatcgttgtattatctactacagggaacacggcaaggctactgtcgaagtatagaccaagctgccctatcatattagtaacaagacacgcaagaacggcaagaattgcgcatttgtatagaggtgttttcccatttctgtatgaaccgaaacgcctagacgactggggtgaggatgttcataggcgcctaaagtttggtgttgaaatggcgaggtctttcggaatggtggacaacggtgatactgttgtttccattcaaggattcaaaggaggagtcggccattccaataccttacgcatttctactgttggtcaagaattctag

SEQ ID NO: 758 - DNA, 1131 bp, Saccharomyces cerevisiae
atgtcaacgtttgggaaactgttccgcgtcaccacatatggtgaatcgcattgtaagtctgtcggttgcattgtcgacggtgttcctccaggaatgtcattaaccgaagctgacattcagccacaattgaccagaagaagaccgggtcaatctaagctatcgacccctagagacgaaaaggatagagtggaaatccagtccggtaccgagttcggcaagactctaggtacacccatcgccatgatgatcaaaaacgaggaccaaagacctcacgactactccgacatggacaagttccctagaccttcccatgcggacttcacgtactcggaaaagtacggtatcaaggcctcctctggtggtggcagagcttctgctagagaaacgattggccgtgtcgcttcaggtgccattgctgagaagttcttagctcagaactctaatgtcgagatcgtagcctttgtgacacaaatcggggaaatcaagatgaacagagactctttcgatcctgaatttcagcatctgttgaacaccatcaccagggaaaaagtggactcaatgggtcctatcagatgtccagacgcctccgttgctggtttgatggtcaaggaaatcgaaaagtacagaggcaacaaggactctatcggtggtgtcgtcacttgtgtcgtgagaaacttgcctaccggtctcggtgagccatgctttgacaagttggaagccatgttggctcatgctatgttgtccattccagcatccaagggtttcgaaattggctcaggttttcagggtgtctctgttccagggtccaagcacaatgacccattttactttgaaaaagaaacaaacagattaagaacaaagaccaacaattcaggtggtgtacaaggtggtatctctaatggtgagaacatctatttctctgtcccattcaagtcagtggccactatctctcaagaacaaaaaaccgccacttacgatggtgaagaaggtatcttagccgctaagggtagacatgaccctgctgtcactccaagagctattcctattgtggaagccatgaccgctctggtgttggctgacgcgcttttgatccaaaaggcaagagatttctccagatccgtggttcattaa

SEQ ID NO: 759 - DNA, 1758 bp, Saccharomyces cerevisiae; identical to SEQ ID NO: 699

SEQ ID NO: 760 - DNA, 2592 bp, Saccharomyces cerevisiae
atgccatctgctagcttactcgtctcgacaaagagacttaacgcttccaaattccaaaaatttgtgtcttcattaaacaaatccaccatagcaggatttgcatctgtacccttgagagctccaccatccgttgcatttacgagaaagaaagtcggatactcaaagaggtatgtttcatctactaacggcttttcagctactagatccactgtgatccaactgttgaacaatatcagcacaaaaagagaggttgaacaatatttgaaatatttcacttccgtctcacaacaacaatttgctgtgatcaaggtgggtggtgccattatcagcgacaatctacacgaactcgcttcctgcttggcatttttgtatcatgttggtctatatccaatagttttacatggtaccggtcctcaggttaatggaaggctagaagcgcagggaattgagccagactatattgatggtattagaatcacggatgagcacacaatggccgtagttagaaaatgttttttggaacaaaatcttaagctagttactgcattagaacagctaggggtccgtgcaagacccattacttctggtgtttttactgctgactatttggataaggacaaatacaagctagtgggcaatattaaaagtgtcacaaaagagccaattgaagcatctattaaggcaggtgccctaccaatcttgacctctttagccgaaactgcttctggtcaaatgttgaacgtcaacgccgacgtagctgctggtgaattagcccgtgtttttgagcctttgaagatcgtttacctgaatgagaaagggggtattatcaatggctccacgggagaaaaaatttcgatgatcaatttggatgaagagtatgacgatttaatgaagcaaagttgggtgaagtatggtaccaaattaaaaattagagaaattaaagagcttttggactatcttcctcgttcttcttcagttgcaatcattaacgttcaagatctacaaaaagaactgttcactgattctggtgcgggtactatgatcaggagaggttacaaattagtgaagagatcctccattggcgaatttccatccgctgatgctctaagaaaagctcttcaaagggacgctggcattagttccggtaaagaatctgttgcttcttatttaagatatttggaaaactctgattttgtctcttatgctgatgaacctcttgaagcagtggccattgtaaagaaagatacgaacgttcccacactagacaaatttgtctgttctgacgcagcctggttgaataacgtcacagataatgtattcaatgttttgcgccgtgattttcctgctttacaatgggtagtcagtgaaaatgatgctaacattgcatggcattttgataagtctcaaggttcatatctaaaaggcggaaaagttttgttctggtatggtatcgatgatataaatacaatatccgagctcgttgaaaattttgtgaagtcgtgtgacactgcttctaccctcaactcatcagcaagtagtggagtatttgctaacaaaaaatcagctaggtcgtactcaactagatccactcctcgtcccgagggagttaacaccaaccctggtcgtgtcgcgcttattggtgctagaggttacacaggtaaaaatttggtatctttgatcaacggccacccatatttagaagtggcccatgtttcttctcgtgaattgaaaggtcaaaagttgcaagattatacaaaatccgaaattatatatgaaagtttgcaaatacaggatattaggaaactggaagaacaaaatgctgtggacttttgggttatggcattacccaacaaagtctgtgaacctttcgttgagacaatccaaagtgttcatggtaagtctaaaattattgatctgtccgctgatcacaggtttgtatcagaatcagactgggcttacggtttgccagaattgaatgatagagcaaaaattgcaaacgctgccaaaattgctaatcccggttgttatgctactggttcgcaattaactatttctccgttaacaaagtatatcaatggtcttccaactgtgtttggtgtttcagggtattcaggcgcggggacgaagccttctccaaaaaacgatcccaaattcttgaacaataacttaattccttacgctttaagtgatcatatacacgaacgcgaaatctcagctcgcattgggcacaatgttgcattcatgccccatgttgggcagtggtttcaaggtatctctttgaccgtctctattccaataaaaaaaggttccttgtctattgatgagatcaggaaattatacagaaatttttacgaagacgaaaagctagtacatgtcatcgatgatatcccactggttaaagatattgagggcacccatggtgtagttattggtggtttcaagctgaatgatgctgaagatcgtgtagttgtttgcgcaaccatcgataacttacttaaaggcgccgctactcaatgtctgcaaaatattaatcttgctatgggttatggagagtatgctggtatccctgaaaataaaattattggtgtctga

SEQ ID NO: 761 - DNA, 1326 bp, Saccharomyces cerevisiae
atgagaatatcatcaacattgcttcaacgctcgaagcagcttatagataagtatgcattatacgtgcccaagacgggctcttttcctaaaggatttgaagtaggctacactgcatctggagtcaaaaaaaacgggagcctggacctgggtgtaatcttgaataccaataaatctcgtccttcaaccgcagcagctgttttcacgaccaataaattcaaagctgcgccagttttgacatcgaaaaaagtccttgaaactgctcgtggtaaaaacatcaacgctattgtagtcaattccggttgtgctaactcggtcacaggtgatcttggtatgaaagatgcccaagtaatgattgatttggttaacgataaaattggtcaaaaaaattctaccctagtcatgtctacaggcgttattggacaacgactacagatggacaagatcagcactggtatcaataaaatttttggagaagaaaagttcggcagtgattttaactcttggttgaacgtagccaaatcaatctgtactactgatactttcccaaaattagttacatctagattcaaattacctagtggtactgagtatactttgacaggtatggcaaagggcgcgggtatgatttgtccgaatatggctaccttattaggtttcatagttacagatcttcctattgaaagcaaggcgttgcagaagatgctgactttcgctactacccgttcatttaattgtatatcggtggacggtgatatgagcaccaatgacacaatttgcatgttggccaacggtgctattgacaccaaagaaattaacgaagactctaaagattttgaacaagtaaaattgcaggtcacagaatttgctcagcgcttggcccagttagtcgttcgcgatggtgaaggttcgacaaagtttgttactgttaacgttaaaaatgctttgcattttgaagacgccaaaataattgctgaatcaatctcaaactctatgttggtcaaaaccgcactatatgggcaagatgccaattggggaagaatattgtgcgcgatcgggtatgcaaagctgaatgacttaaaatctctagatgtcaacaaaattaatgttagctttattgctaccgacaattcagaacctcgtgagctgaagcttgtcgctaatggtgtgccacaattggagatcgatgaaacaagggcttctgaaatattggctttgaatgatttggaagtgtctgtcgacttgggaaccggtgatcaggcagcacaattttggacttgtgatttatcacatgaatatgtaacaattaacggtgattaccgttcataa

SEQ ID NO: 762 - DNA, 1284 bp, Saccharomyces cerevisiae; identical to SEQ ID NO: 643

SEQ ID NO: 763 - DNA, 957 bp, Saccharomyces cerevisiae; identical to SEQ ID NO: 644

SEQ ID NO: 764 - DNA, 984 bp, Saccharomyces cerevisiae; identical to SEQ ID NO: 646

SEQ ID NO: 765 - DNA, 1431 bp, Saccharomyces cerevisiae
atctgtgaaaatttggacattcacccatcgaaagtagaattagggaagttttctaatggggaaacgaacattgctcttcgcgaatctgttcgtgaaaaggatgtatatatcatccagagtggttgtggccaggtgaacgacacgttcatgcagttgctgattttaatcagtgcctgcaagtccgcttctgcctcgagggttacagccgtaatgccatatctctgctactcgagacagccagatattccatatactgccaagggtgctcccataatttccaagcctaaagaaaactatacttttgaatcgcatccaggcacacccgtgtcatcttctttaatgacgcaaagaccaggtgctgagagctcgttgaagagtttggatagtgcaatacgatcaactatcaacttagaaaatcctcaacctatcagaacaccaaacagcagtgctacggcgaataacaatttcgacatcaagaagacgctttctttttcaagaattcctatgattcccggtggtaagttacaaaatacaagcaatagcacggacgctggtgaattgttcaacgctcaaaatgcaggctataagctatgggtagtacaagccggtactttgattgctcatttgttgagtgctgcaggtgctgaccatgtgatcacaatggatttgcacgatccacagttccctgggttttttgacattccagtggataatctctactgtaaacccattgcacaaaactacatccagcatcgcattccagattatcaggatgctgtgatcgtttctccagatgctggtggtgcaaagagagctacggctattgcagacgccttggaattgtccttcgccctaattcataaagaaagaagatctcagttattgaagggccctccagatgcgacgttaacctctggtggttcgttaccagtatctccaaggccattagttactactttggtttcctcccaaaatactacttcttcaggtgccactggggttgcggcccttgaaatgaagaaaacaacttcaacatcttccacctcgtcgcaatcttctaattcgtccaagttcgttcaaactaccatgcttgttggcgatgttagaaacaaggtgtgtattatagtcgacgacttggtggatacttcatacactattacaagagctgcgaaattgttgaaggatcaaggatctaccaaagtttatgccttaataacgcacggtgttttttccggtgatgcgctagaaagaatcggccaaagtagtatagataagttgatcatttctaacacggttcctcaagatagaacactacagtacctaggtaaggacagagtggatgttattgatgtctcctgcataatcggtgaagcaattagaagaatccataacggtgaatccatttctatgttgttcgagcatggatggtag

SEQ ID NO: 766 - DNA, 1143 bp, Saccharomyces cerevisiae; identical to SEQ ID NO: 668

SEQ ID NO: 767 - DNA, 663 bp, Escherichia coli
atgaaagacatagatacactcatcagcaacaatgcactatggtcaaaaatgctggtggaagaggatcccgggttttttgagaaactggcacaagcgcaaaaaccgcgctttctatggattggatgttccgacagtcgcgttcctgcagaacgtttaaccggtcttgagccgggcgaactctttgttcaccgtaatgttgctaacctggtcattcacactgacctgaactgcctttccgtggttcagtatgcagtggatgtactcgaagttgaacacattattatctgtggccactacggttgcggcggcgtacaagccgcagttgaaaacccggaactggggcttatcaacaactggctgctgcatatccgcgatatctggttcaaacatagctcattgctcggcgaaatgccgcaagagcgccgtctggataccttgtgtgaactgaacgtcatggaacaggtgtataacctgggccactccaccattatgcaatcagcgtggaaacgcgggcagaaagttaccattcacggctgggcctacggcattcacgacggcttgctgcgtgatctggatgttaccgccaccaaccgcgaaacccttgagcaacgttaccgtcacgggatttccaacctcaagctgaaacacgccaaccacaaataa

SEQ ID NO: 768 - protein, 220 aa, Escherichia coli
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLGEMPQERRLDTLCELNVMEQVYNLGHSTIMQSAWKRGQKVTIHGWAYGIHDGLLRDLDVTATNRETLEQRYRHGISNLKLKHANHK

SEQ ID NO: 769 - DNA, 780 bp, Escherichia coli
atgggttttctttccggtaagcgcattctggtaaccggtgttgccagcaaactatccatcgcctacggtatcgctcaggcgatgcaccgcgaaggagctgaactggcattcacctaccagaacgacaaactgaaaggccgcgtagaagaatttgccgctcaattgggttctgacatcgttctgcagtgcgatgttgcagaagatgccagcatcgacaccatgttcgctgaactggggaaagtttggccgaaatttgacggtttcgtacactctattggttttgcacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcgcgctatcccgaactacaacgttatgggtctggcaaaagcgtctctggaagcgaacgtgcgctatatggcgaacgcgatgggtccggaaggtgtgcgtgttaacgccatctctgctggtccgatccgtactctggcggcctccggtatcaaagacttccgcaaaatgctggctcattgcgaagccgttaccccgattcgccgtaccgttactattgaagatgtgggtaactctgcggcattcctgtgctccgatctctctgccggtatcttcggtgaagtggtccacgttgacggcggtttcagcattgctgcaatgaacgaactcgaa

SEQ ID NO: 770 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGIFGEVVHVDGGFSIAAMNELELK

SEQ ID NO: 771 - DNA, 960 bp, Escherichia coli
atgagtctgaatttccttgattttgaacagccgattgcagagctggaagcgaaaatcgattctctgactgcggttagccgtcaggatgagaaactggatattaacatcgatgaagaagtgcatcgtctgcgtgaaaaaagcgtagaactgacacgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgctttaagatgcctatcatcacctttatcgacaccccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaa

SEQ ID NO: 772 - protein, 319 aa, Escherichia coli
MSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMQMAERFKMPIITFIDTPGAYPGVGAEERGQSEAIARNLREMSRLGVPVVCTVIGEGGSGGALAIGVGDKVNMLQYSTYSVISPEGCASILWKSADKAPLAAEAMGIIAPRLKELKLIDSIIPEPLGGAHRNPEAMAASLKAQLLADLADLDVLSTEDLKNRRYQRLMSYGYA

SEQ ID NO: 773 - DNA, 471 bp, Escherichia coli
atggatattcgtaagattaaaaaactgatcgagctggttgaagaatcaggcatctccgaactggaaatttctgaaggcgaagagtcagtacgcattagccgtgcagctcctgccgcaagtttccctgtgatgcaacaagcttacgctgcaccaatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaa

SEQ ID NO: 774 - protein, 156 aa, Escherichia coli
MDIRKIKKLIELVEESGISELEISEGEESVRISRAAPAASFPVMQQAYAAPMMQQPAQSNAAAPATVPSMEAPAAAEISGHIVRSPMVGTFYRTPSPDAKAFIEVGQKVNVGDTLCIVEAMKMMNQIEADKSGTVKAILVESGQPVEFDEPLVVIE

SEQ ID NO: 775 - DNA, 1350 bp, Escherichia coli
atgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataa

SEQ ID NO: 776 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 777 - DNA, 915 bp, Escherichia coli
atgagctggattgaacgaattaaaagcaacattactcccacccgcaaggcgagcattcctgaaggggtgtggactaagtgtgatagctgcggtcaggttttataccgcgctgagctggaacgtaatcttgaggtctgtccgaagtgtgaccatcacatgcgtatgacagcgcgtaatcgcctgcatagcctgttagatgaaggaagccttgtggagctgggtagcgagcttgagccgaaagatgtgctgaagtttcgtgactccaagaagtataaagaccgtctggcatctgcgcagaaagaaaccggcgaaaaagatgcgctggtggtgatgaaaggcactctgtatggaatgccggttgtcgctgcggcattcgagttcgcctttatgggcggttcaatggggtctgttgtgggtgcacgtttcgtgcgtgccgttgagcaggcgctggaagataactgcccgctgatctgcttctccgcctctggtggcgcacgtatgcaggaagcactgatgtcgctgatgcagatggcgaaaacctctgcggcactggcaaaaatgcaggagcgcggcttgccgtacatctccgtgctgaccgacccgacgatgggcggtgtttctgcaagtttcgccatgctgggcgatctcaacatcgctgaaccgaaagcgttaatcggctttgccggtccgcgtgttatcgaacagaccgttcgcgaaaaactgccgcctggattccagcgcagtgaattcctgatcgagaaaggcgcgatcgacatgatcgtccgtcgtccggaaatgcgcctgaaactggcgagcattctggcgaagttgatgaatctgccagcgccgaatcctgaagcgccgcgtgaaggcgtagtggtacccccggtaccggatcaggaacctgaggcctga

SEQ ID NO: 778 - protein, 304 aa, Escherichia coli
MSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 779 - DNA, 1533 bp, Escherichia coli
atgcgaattggcataccaagagaacggttaaccaatgaaacccgtgttgcagcaacgccaaaaacagtggaacagctgctgaaactgggttttaccgtcgcggtagagagcggcgcgggtcaactggcaagttttgacgataaagcgtttgtgcaagcgggcgctgaaattgtagaagggaatagcgtctggcagtcagagatcattctgaaggtcaatgcgccgttagatgatgaaattgcgttactgaatcctgggacaacgctggtgagttttatctggcctgcgcagaatccggaattaatgcaaaaacttgcggaacgtaacgtgaccgtgatggcgatggactctgtgccgcgtatctcacgcgcacaatcgctggacgcactaagctcgatggcgaacatcgccggttatcgcgccattgttgaagcggcacatgaatttgggcgcttctttaccgggcaaattactgcggccgggaaagtgccaccggcaaaagtgatggtgattggtgcgggtgttgcaggtctggccgccattggcgcagcaaacagtctcggcgcgattgtgcgtgcattcgacacccgcccggaagtgaaagaacaagttcaaagtatgggcgcggaattcctcgagctggattttaaagaggaagctggcagcggcgatggctatgccaaagtgatgtcggacgcgttcatcaaagcggaaatggaactctttgccgcccaggcaaaagaggtcgatatcattgtcaccaccgcgcttattccaggcaaaccagcgccgaagctaattacccgtgaaatggttgactccatgaaggcgggcagtgtgattgtcgacctggcagcccaaaacggcggcaactgtgaatacaccgtgccgggtgaaatcttcactacggaaaatggtgtcaaagtgattggttataccgatcttccgggccgtctgccgacgcaatcctcacagctttacggcacaaacctcgttaatctgctgaaactgttgtgcaaagagaaagacggcaatatcactgttgattttgatgatgtggtgattcgcggcgtgaccgtgatccgtgcgggcgaaattacctggccggcaccgccgattcaggtatcagctcagccgcaggcggcacaaaaagcggcaccggaagtgaaaactgaggaaaaatgtacctgctcaccgtggcgtaaatacgcgttgatggcgctggcaatcattctttttggctggatggcaagcgttgcgccgaaagaattccttgggcacttcaccgttttcgcgctggcctgcgttgtcggttattacgtggtgtggaatgtatcgcacgcgctgcatacaccgttgatgtcggtcaccaacgcgatttcagggattattgttgtcggagcactgttgcagattggccagggcggctgggttagcttccttagttttatcgcggtgcttatagccagcattaatattttcggtggcttcaccgtgactcagcgcatgctgaaaatgttccgcaaaaattaa

SEQ ID NO: 780 - protein, 510 aa, Escherichia coli
MRIGIPRERLTNETRVAATPKTVEQLLKLGFTVAVESGAGQLASFDDKAFVQAGAEIVEGNSVWQSEIILKVNAPLDDEIALLNPGTTLVSFIWPAQNPELMQKLAERNVTVMAMDSVPRISRAQSLDALSSMANIAGYRAIVEAAHEFGRFFTGQITAAGKVPPAKVMVIGAGVAGLAAIGAANSLGAIVRAFDTRPEVKEQVQSMGAEFLELDFKEEAGSGDGYAKVMSDAFIKAEMELFAAQAKEVDIIVTTALIPGKPAPKLITREMVDSMKAGSVIVDLAAQNGGNCEYTVPGEIFTTENGVKVIGYTDLPGRLPTQSSQLYGTNLVNLLKLLCKEKDGNITVDFDDVVIRGVTVIRAGEITWPAPPIQVSAQPQAAQKAAPEVKTEEKCTCSPWRKYALMALAIILFGWMASVAPKEFLGHFTVFALACVVGYYVVWNVSHALHTPLMSVTNAISGIIVVGALLQIGQGGWVSFLSFIAVLIASINIFGGFTVTQRMLKMFRKN

SEQ ID NO: 781 - DNA, 1389 bp, Escherichia coli
atgtctggaggattagttacagctgcatacattgttgccgcgatcctgtttatcttcagtctggccggtctttcgaaacatgaaacgtctcgccagggtaacaacttcggtatcgccgggatggcgattgcgttaatcgcaaccatttttggaccggatacgggtaatgttggctggatcttgctggcgatggtcattggtggggcaattggtatccgtctggcgaagaaagttgaaatgaccgaaatgccagaactggtggcgatcctgcatagcttcgtgggtctggcggcagtgctggttggctttaacagctatctgcatcatgacgcgggaatggcaccgattctggtcaatattcacctgacggaagtgttcctcggtatcttcatcggggcggtaacgttcacgggttcggtggtggcgttcggcaaactgtgtggcaagatttcgtctaaaccattgatgctgccaaaccgtcacaaaatgaacctggcggctctggtcgtttccttcctgctgctgattgtatttgttcgcacggacagcgtcggcctgcaagtgctggcattgctgataatgaccgcaattgcgctggtattcggctggcatttagtcgcctccatcggtggtgcagatatgccagtggtggtgtcgatgctgaactcgtactccggctgggcggctgcggctgcgggctttatgctcagcaacgacctgctgattgtgaccggtgcgctggtcggttcttcgggggctatcctttcttacattatgtgtaaggcgatgaaccgttcctttatcagcgttattgcgggtggtttcggcaccgacggctcttctactggcgatgatcaggaagtgggtgagcaccgcgaaatcaccgcagaagagacagcggaactgctgaaaaactcccattcagtgatcattactccggggtacggcatggcagtcgcgcaggcgcaatatcctgtcgctgaaattactgagaaattgcgcgctcgtggtattaatgtgcgtttcggtatccacccggtcgcggggcgtttgcctggacatatgaacgtattgctggctgaagcaaaagtaccgtatgacatcgtgctggaaatggacgagatcaatgatgactttgctgataccgataccgtactggtgattggtgctaacgatacggttaacccggcggcgcaggatgatccgaagagtccgattgctggtatgcctgtgctggaagtgtggaaagcgcagaacgtgattgtctttaaacgttcgatgaacactggctatgctggtgtgcaaaacccgctgttcttcaaggaaaacacccacatgctgtttggtgacgccaaagccagcgtggatgcaatcctgaaagctctgtaa

SEQ ID NO: 782 - protein, 462 aa, Escherichia coli
MSGGLVTAAYIVAAILFIFSLAGLSKHETSRQGNNFGIAGMAIALIATIFGPDTGNVGWILLAMVIGGAIGIRLAKKVEMTEMPELVAILHSFVGLAAVLVGFNSYLHHDAGMAPILVNIHLTEVFLGIFIGAVTFTGSVVAFGKLCGKISSKPLMLPNRHKMNLAALVVSFLLLIVFVRTDSVGLQVLALLIMTAIALVFGWHLVASIGGADMPVVVSMLNSYSGWAAAAAGFMLSNDLLIVTGALVGSSGAILSYIMCKAMNRSFISVIAGGFGTDGSSTGDDQEVGEHREITAEETAELLKNSHSVIITPGYGMAVAQAQYPVAEITEKLRARGINVRFGIHPVAGRLPGHMNVLLAEAKVPYDIVLEMDEINDDFADTDTVLVIGANDTVNPAAQDDPKSPIAGMPVLEVWKAQNVIVFKRSMNTGYAGVQNPLFFKENTHMLFGDAKASVDAILKAL

SEQ ID NO: 783 - protein, 1220 aa, Chloroflexus aurantiacus
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWGAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 784 - protein, 1219 aa, Chloroflexus aurantiacus
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 785 - protein, 1219 aa, Chloroflexus aggregans
MSVTGRLAGKIALITGGAGNIGSEMTRRFLAEGATVIISGRNSAKLAALAERLRSEAGVPAKRIDLEVMDGSDPAAVRAGVAAIIGRHGHIDILVNNAGSTGAQRRLAEIPLNETDRDLDDEEALSTSVANLLGMAWHLMRILSPHMPPGSAIINISTIFSRAEYYGRIPYVVPKAALNTLTQIAARELGIRGIRVNTIFPGPIESERIQTVFQRMDQLKGRPEGDTASQFLATMRLYRANDQGQLERRFPTICDVADAAVFLASDEAAALTGETIEVTHGMELPTSSETSLLARTDLRTIDANGRTTLICAGDQIEEVMALTGMLRTCGSEVIIGFRSEAALAQFEQAIGESRRLAGESFIPPIALPIDLRNPSTIDALFDWAGENTGGIHAAVILPASGREPATQVIDIDDAHVQAFLNDEIVGSIIIASRLARYWQAQRIAPGARAREPRVIFLSNGASTAGNPYGRIQSAAIEQLIRVWRHEAALDYERATAAGERVLPAVWASQIVRFANRSLEGLEFACAWTAQLLHSQRRINEITLTIPADISATTGARSASVGWAESLIGLHLGKVALITGGSAGIGGQIGRLLALSGARVMLAARDPHKLEQIQATIRAELAEVGYTDVEERVQIAPGCDVSSEEQLVDLVERTLAAFGTVDYLINNAGIAGVEEMVIDMPVEGWRNTLYANLISNYSLMRKLAPLMKKQGSGYVLNVSSYFGGEKDAAIPYPNRADYAVSKAGQRAMAEVFARFLGPEIQINAIAPGPVEGDRLRGTGERPGLFARRARLILENKRLNELHAALITAARTDNRPMRELVELLLPNDVAALAQHPAAPDVLRTLAKRFQSEGDPAASSSSFLLNRSIAAKLLARLINGGYDLPADIFANLAVPPDPFFTRAQIDREARKVRDGIMGMLYLQRMPTEFDVAMATVYYLADRNVSGETFHPSGGLRYERTPTGGELFGLPAPERLAELVGSTVYLIGEHLTEHLNLLARAYLERYGARQVVMIVETEAGAEKMRHLLHDHVEAGRLPIIVAGDQIEAAIDQAIANYGRPGPVVCTPFRPLPSAPLVGRKDSDWSTVLSEAEFAELCEHQLTHHFRVARKIALSDGASLALVTPETTATSSTEQFALANFVKTTLHAFTATIGVESERTAQRILINQVDLTRRARAEEPRDPRERQQELERFIEAVLLVTAPLPPEADTRYAGRIHRGRAITV

SEQ ID NO: 786 - protein, 1229 aa, Roseiflexus castenholzii
MSTVRRLEGKVALITGGAGNIGEVITRRFLAEGATVVITGRNAEKLAVYRRRLIDEERVAPERVVALRMDGSDIAQVRAGVAQIVHGGTDVPIPLHRIDILVNNAGSAGPRRRLVDIPLEPSEVQPPDSETLAQAVGNLVGITWNLTRAAAPHMPSGSSVINISTIFSRTDYYGRIAYVAPKAALNALSDGLARELGVRGIRVNTIYPGPIESERIYTMFQAMDALKGQPEGDTASGFLRMMRLSRIDQNGEVVKRFPSPVDVANTAVFLASDESAAFTGHAFEVTHGMEVPTESRTTFVSRPGLRSVDATGKVILICAGDQVDDAVALADTLRSCRATVVIGFRDPRALEKASVLLREPRHALAADMYGRPTMTAEARLVRLDPLDPRAAAQTLEQIHAELGAIHHAVVLPGQSRHAPSASLIEVDDQVVERFLHQELVGTIALARELARFWEEYPSGSSMHRVLFVSNPDDQQGNQYSHILRAAVEQLVRVWRHESEYDSVNPAHQQEGQSSAAVWANQLIRYVNNEMANLDFTCAWVAKLLGSDRRIAEINLYLPEEIVGTIGVHNPGFGWAESLFGLHMGKVALITGGSAGIGGQIGRLLALSGAHVMLAARNADQLEQMRASIVREVRDASYPDAESRVAIFPGSDVSDIDGLERLVNHTVRVFGKVDYLINNAGIAGAEEMVIDMPVDAWRHTLRANLISNYALLRRLAPQMKAAGGAYVLNVSSYFGGEKYVAIPYPNRSDYAVSKAGQRAMVESLARFLGPEIQINAIAPGPVEGERLKGAGSRPGLFMRRARLILENKRLNEVFAALLAARHEGATIADLLPDLFANDIQSIANSAAMPAPLRRLATMLRETSDAGGSAQSYLMNATIARKLLNRLENGGYITLHDRRALTVEPPEPFFTEAQIEREAIKVRDGILGMLHLQRMPTEFDVALATVFYLADRNVTGETFHPSGGLRFERTVTEGELFGKPGQQRLERLKGSVVYLIGEHLRQHLVLLARTFLDEIHVARVVLLTETTQAATDLAAELSDYEAAGRFVVIPTCGDIEGGIDRAMAEYGRPGPVISTPFRPLPDRALSARNGDWSSVLTTAEFEELVEQQITHHFRVARKAGLIEGANVTLVTPPTSARSTSEEFALANFVKTTLHALTATAGAESERTVPHVPVNQVDLTRRARSEEPRTPSEEEEELQRFVNAVLLTSAPLPTPLESRYRARIYRGNAITV

SEQ ID NO: 787 - protein, 1232 aa, Roseiflexus sp.
MSTTRRHDRLEGKVALITGGAGNIGEVITRRFLAEGATVVITGRNVEKLAAYRRRLIDEERIAPDRVVALRMDGSDMAQVRAAIAQIVHGGADVPTPLKRIDILVNNAGSAGPRRRLVDIPLEPSEVHPPDTETLAQAVGNLVGVAWNLTRAAAPYMPPGSSIINVSTIFSRTDYYGRIAYVVPKAALNALSQGLARELGVRGIRVNTIYPGPIESERIHTVFQAMDALKGQPEGETARSFLRLMRLSRADTQGEVTKRFPLPVDVANTAVFLASEESAAFTGHAFEVTHGMEAPVESRTTFVSRPGLRSVDATGNVILICAGDQVDDAIALSDTLRSCRATVVVGFRDVQALEKASALLREPRHVAPADMYGRPTMVAETRLVHLDPLDSRAAAQTLERIRAELGTLHHAVILPASLRHAPTESLIDVDDRIIDRFLEQELVGAIALARELARFWEEHPAGSRAHRVLFVSNPDDQQGNRYADILRAAVEQLARVWRHESEYDAANPAHRHEDQPGAAVWANQLIRYVNSESANLDFTCAWVAKLLGSDRRIAEINLYLPEQIVSTIGVHNPGFGWAESLFGLHMGKVALITGGSAGIGAQIGRLLALSGAHVMLAARNAEQLEQMRALIVREVRDASYPDAESRVAIFPNSDVSDIDGLERLVNHTLRVFGKVDYLINNAGIAGAEEMVIDMPVDAWRHTLRANLISNYALLRRLAPQMKAAGGAYVLNVSSYFGGEKYVAIPYPNRADYAVSKAGQRAMVESLARFLGPEIQINAIAPGPVEGERLKGAANRPGLFMRRARLILENKRLNEVFAALLAARHEGAVIAALLPDLFVNDLQTIADNPAMPAPVRRLATMLRETTDAGGSAQSYLMNATIARKLLNRLENGGYITAGDRRALTNEPPDPFFTEAQIEREAIKVRDGILGMLHLQRMPTEFDVALATVFYLADRNVTGETFHPSGGLRFERTVTEGELFGKPGRQRLERMAGSVVYLIGEHLRQHLLLLARTFLDEIHVARVVLLTETEQAAAELATVFADEEAAGRFVIIPTGGDIEGGIDRAMAEYGRPGPVISTPFRPLPSRALSAQNGDWSNVLTTPEFEELVEQHITHHFRVVRKAGLIEGANVTLVTPPTSARSTAEEFALANFIKTTLHALTATAGAESERTMPHVPVNQVDLTRRARSEEPRTPAEEEEELQRFVNAVLLTSAPLPTPLESRYRARIYRGNAITV

SEQ ID NO: 788 - protein, 1217 aa, Erythrobacter sp.
MSKEGNAAKGRLEGKVALITGAAGNLGNEISRAFAREGAFVVMTGRTEERISAAREQLIADTGVAPERIDTAVLDGGNPDSIRAAMAKLRKEYGRIDILINNAGSAGPKQPLHNVPLSPQEMEACGDTETVRDAMLNILGVTWNMARIVAPMMPVGGAMVNISTIFSHTRYYGRTAYVVPKAALNALSNQLASELGPRGIRVNTVFPGPIESDRIRTVFAAMDEVQSQPKDTTANYFTGRMALTRSVNGKVDGKPLPNPKDIAGTCLFLASEEAAGIAGEEVDVTHGLSANRTSASTYMTRPSMRSLDGAGLNIFIVSGENWDDALVAAHTLIGSGAKVRLGLARNADVAQANARLKAQGIGEELTVTRFNRAEPDAMEDALAAFSGDVDGAITGAIILPVKPSGHFTGSLLAADDDTVTKFMDTELVGAIAVSRSLARYWHGREDLQSPPRCVFMTNPGDPLGNSFASVLSAGITQLIRIWRDEERVQAGNGSTEHAVWSNQIVRHTNTEDENTRFASGHATRVLFREQHIAEIDLKLPANISEETGSRKAMVGFAENITGLHLGKVAFITGGSAGIGGQVARLLALAGAKVMMVARRESELVAARDRIVGELQDIGFAGVERRVKYMADIDVSDFASLDKAVDATLEEFGRIDYLINNAGVAGAEDMVIDMEPEAWRFTLDANLISNYHLMQRVVPLMKEQGSGYVLNVSSYFGGEKFLAVAYPNRADYGLSKAGQRAMVEAFSPFLGPEVQCNAIAPGPVDGDRLSGTGGKPGLFQRRAKLILENKRLNAVYSAVIHAIREGGDAAKILTRLSRNSTSTLSHDAEAPEELRKLALDFASQGDGLCTWDQYLLTDAMAQRLLVRLQLGGFLLGSNEWASLSSSEQTWLKLSPPDDKPFLPAAQVDKVANGVGKGVISQLHLGAMPTEAEVAQATVFFLADRAVSGETFMPSGGLRVERSNTEREMFGSPKQERIDKMKGKTVWIIGEHLSDYVAATIEELVSGCGVAKVVLIAKDKSGEKAVRDQLPNDLSKDALEVLIAGDGLEEAMDEALGHWGKPTTVLSMPGEPLPDHLFEGGNPLSTKDFAHMVEANITRHYRVTRKASLYDGCQVVLVSPDVPYGSDGPGVALANFVKTSLHAFTATVAVENERLVHDVPVNQINLTRRVSSEEPRDADEHAEELRRFTRAVLLVGAPLPDAQDSRYRSKIYRGTSMTV

SEQ ID NO: 789 - protein, 1210 aa, Unknown
  Description of Unknown: Gamma proteobacterium NOR51-B polypeptide
MNTETRTTSGGRLHDKVVILTGAAGNIGSYISRSLLREGANLVMTGRNEPKLQAFVEGLVEEGFDRDNILIAIGDSAKADICREIVKATVNHFGNIDVLVNNAGGAGPRRTLRDIPFSESERLARGDDETMLDAAMNLLAGAWNMTRAAVPHMSEGGSIVNVSTIFSRTHYYGRIPYVVPKSGLNALSIGLAKELGEEHGIRVNTLFPGPIESERIDTVFGNMDALQSAPAGATSQEFRDLMITRRENPDGEYEYRYPTPNDVASTVTWLASEESAALSGHHIEVTNGMQVPAQSRSKLVSWPDKRLEDLSGQVVFLLAGSDYEDALAFAERHMVSGAKVVLAFRSLESLGLARSLCASRDLESIHLLHLEPLRRESADRCFDYIRDHFGRLDGIVVLPRSGNGEHGYSLSTAGDDDVEAFVRDEIISPVAFAAALAINLDRWGILEEAPALTYVTNPTDGHGDYLNEVKRAAIEALIRIWRHEDRQMRKKGEREWAMLPNQLVRYDNNEEDNLTFTADWAATLTNRVRRMDPINLWVPESIMRATGKSGMPQSIQRVLPGLHKGRTAVITGGSLGIGLQLGRFLAIAGARVLLSARSKEKLEEARHEIVEELRGVGYPNAHQRVHILPDIDVGDEEALERLYNHSIELFGNVDFLINNAGISGAEEMVVDMSLEAWNRTMYANLISNYSLIRKYAPKMKANGYGVVLNVSSYFGGEKYVAVAYPNRADYAVSKAGQRVLAEILSRHLGPEIRINALAPGPVDGARLRGLGGAPGLFERRGRLVLENKRLNSVHKAVLAALREGATPEVIMALSRNALGDAKPTAGQSKALDKLFAQVEDSPEGGNSTAFLLNRDLAEKLMNRLVTGGLFTPESATQFMEGFVDAPAIFFDEKSVNKAAAGIEAGILNRLHLHKMPTDEQIGLSTVFHLADDIASGETFHPSGGLKFDRSVTEGELLLPPDRDSLAKLKGKRVVLIGDSMREELSAIGNGFINQGVASLTVLTRSPEACEEVQHSLQKSNSVTLDVRCIEDNIEDALDDLLQNQGGFDVVVSAPFSRLPYNPLAAEREGSWNRVLSHTDFARLIDEQLTHHFRVARRAALVPNCQIVLLTPDTSFVSSREEFALALFVKNSLHAFTVTLGVETERLPTVPAVNQVQLTRRARAEEPATESELQEEMERLVSAVLQCAVPAPSPSESRYLARIFRGNAVTV

SEQ ID NO: 790 - protein, 1214 aa, Unknown
  Description of Unknown: Gamma proteobacterium NOR5-3 polypeptide
MNNQNTTQTHSTSGARLDNKVVILTGAAGNIGAFVSRNLLREGAKLVMTGRNEPKLKSFVEELVGEGFDREKILIAIGDSAKADVCRRIVASAVEQFGKIDVLVNNAGGAGPRRTLREIPFSESERLARGDDETMFDAAMNLLAGPWNMTRAAVPHMVRGGSIVNVSTIFSRTHYYGRIPYVVPKSGLNALSIGLAKELGEEHGIRVNTLFPGPIESERIDTVFGNMDALQSAPAGTTSQEFRDLMITRRENPEGEFEYRYPTPNDVASTVTWLACGESAALSGHHIEVTNGMQVPAQSRSKLVSWPDKRLEDLSGQVVFVLAGSDYEDALAFSERHIVSGAKVVLAFRSLESLGYARSLIASRGLDSIHLLHLEPLRRESADRCFDYIRDHFGRLDGIVVLPRSGNGQHGYSLSTAGDDDVEAFVRDEIVSPVAFAAQLAINLDRWGMLDEAPALTYVTNPTDGHGDYLNEVKRAAIEALIRIWRHEDRQMRKKGERQWAMLPNQLVRYDNDEEDNLTFTADWAATLTNRVRRMDPINLWVPESIKRATGKGSMPQSIQRVLPGLHKGRTAVITGGSLGIGLQLGRFLAIAGARVLLSARSKEKLEEARNGIVEELRAVGYPNAHQRVHILPDIDVGDEEALVRLYDHSIELFGHVDFLINNAGISGAEEMVVDMTLEAWNRTMYANLISNYSLIRKYAPKMKANGYGIVLNVSSYFGGEKYVAVAYPNRADYAVSKAGQRVLAEILSRHLGPEIRINALAPGPVDGARLRGLGGAPGLFERRGRLVLENKRLNFVHKAILAAIDEKVSDESILALAKNALSEMKRVAGQSKALGKLCAQVEDSREGGNSAAYLLNKDLADKLLKRLVTGGLFKPESAEAFMEAFVDAPTPFFDEKAVKKAADGIEAGILNRLHLHKMPTDEQIGLSTVFHLADDIASGETFHPSGGLKFDRSVTEGELLLPPDRESLARLGGKRVVLIGDAMREEMSAIGNGFIEREVASLTVLTRTAEAQEEILHSLPGTGKTKVDVRVIGDNLEDALDDLVQNQGGFDVVVSAPFSRLPYNPLAAEREGSWERVLSHTDFAKLVDEQLTQHFRVARRAALVPNCQIVLLTPDTSFVSSREEFALALFVKNSLHAFTVTLGVETERLPTVPAVNQVQLTRRARTEEPASESELEEELERLVYAVLQCAVPAPSPTESRYLARIFRGNAVTV

SEQ ID NO: 791 - protein, 1216 aa, Unknown
  Description of Unknown: Marine gamma proteobacterium HTCC2080 polypeptide
MNDFVQFTDDMTSQSKSGKRLDNKSIILTGAAGSIGRFITRQLLCEGARVMMTGRDISKLEEFVDSLCDDGFDRENMVVTVGDCADPEVCRRIVADTVEAFGTIDVLVNNAGAAGPKYTLRDIPFSDVEMKTAGSDQTMFDSAMNLLGAPWNMARAAAPHMSVGASIINVSTIFSRTHYFGRIPYVVPKSGLNALSKGLALELGEEQGIRVNTVFPGPIESERIDTVFARMDELQNLEPGSTGREFRDLMITTREGEEGLEYRYPTPTDVASSITWLASGESAAVSGHAVEVTNGMQVPAQSRSQLVSWPDKRLEDLSDHIVLILGGSDYEEAVTFAERHTESGARVLLAFRNLESVGHARSIIQARELESVQLSHLDPLRRESVDRTMQFIDDHFGRLDGVIVLPQKKNGQYGYSICSATDDDVENFVKDEVVAPVAFASTLATNLSRWFGKCDPPAITYVTNASDGHGNLLNEVIRASNEALIRGWRHEDETLKAAGELSWSVQPNQLVRYDTEDRDALPFAADWAATLTNRVRQMDPINLWIPKDIKRATGKGAMPTSLMRVLPGLHKGKTAVITGGSLGIGLQLGRYLAIAGARVLLSARSEAKLIEAKAEIVAELSGIGYPNADNRIHVLANIDVGDPAALETLHQHAVDLFGQVDFLINNAGISGAEEMVVDMTLKDWDRTMEANLISNYSLIRKFGPLMKDKGRGSILNVSSYFGGEKYVAVAYPNRADYAVSKAGQRVLAEILSRHLGPEIQINALAPGPVDGARLRGLGDAPGLFDRRGRLVLENKRLNQVHAAIISAVADGYPIEEIRKLSANAVEVLPTHNLPSVLSRLYSQVKDSGGTGSSSKCLLHMGMAVKLVERLVNAGIFTTEDKDEFLGSFVDAPSPFFDKEACKRSATQIESGILNRLHLHKMPTDEQVGLSTVFHLADEIVSGETFHPSGGLKFDRSVTEGELLLSPSEKDLARLSGKRVVILGDCMRNEITEIAKGFKSNGVEKLWILTRSEETKTTLYHALECDSVENIDVRCIGDDIEGALDNLLRHDGGFDVVVSSPFERLPLNALAGDRGGDWDRVLSDEQFRQLVHQQLTHHFRSARIAALIPSCQIVLLTPETSLASTREEFALALFVKNSLHAFTVTLGVEGERLPTVPAVNQVQLTRRAHTEEPSNDQELSEEMERLVAAVMQCSVPAPSPKESRYLSKIFRGNAVTV

SEQ ID NO: 792 - protein, 219 aa, Psuedomonas fluorescens
  Carbonic anhydrase P. fluorescens Pf-5
MQNIIDGFLKFQREAFPQRSELFKQLASTQNPGTLFVTCSDSRVVPELLTQQEPGDLFVIRNAGNIVPSYGPEPGGVSATVEYAVAVLGVSDIVICGHSDCGAMTAISTCKCLDHLPAVANWLRHAESAKVINAARQHASPAEHLDALVRDNVIAQLANLKTHPSVALALEQGRLNLHGWVYDIESGAIVALDGNTQRFVSLAEYPHTCALASQASSAA

SEQ ID NO: 793 - protein, 213 aa, Yersinia ruckeri
  Carbonic anhydrase Y. ruckeri ATCC 29473
MQDIIDGFLKFQREVFPQRSELFKRLADTQHPGALFVTCSDSRVVPELLTQREPGELFVIRNAGNIVPSYGPEPGGVSATVEYAVAVLGVTDVVICGHSNCGAMSAIAECQCLDHLPAVAAWLRHADSAKLVNAALPHASPKDRLNSLVRENVIAQLANIKTHPSVALACAQGRLRLHGWVYDIETGSIDVLDELTRTFSPLSAYSVVSKPTE

SEQ ID NO: 794 - protein, 219 aa, Hahella chejuensis
  Carbonic anhydrase Hahella chejuensis KCTC 2396
MKDIIEGFLKFQREAFPERKELFKDLANQQQPRTLFISCSDSRLVPELVTQREPGDLFVIRNAGNIVPPYGPEPGGVSASVEYAVAALRVADIVVCGHSNCGAMTAVATCQCIDHMPAVAHWLRYADSAKVVNQARKHASERAKIEDMVRENVIAQLANLQTHPSVRLALQEGRLTMHGWFYDIESGGIDAYDGSRHAFVPLAEHPEARAIPGKLSHAV

SEQ ID NO: 795 - protein, 219 aa, Burkholderia cenocepacia
  Carbonic anhydrase Burkholderia cenocepacia J23152
MKDIIEGFLKFQRDAYPARAALFRDLARSQNPRALFISCSDSRLVPELVTQREPGDLFVIRNAGNIVPSYGPEPGGVSASVEYAVAALRVTDVVICGHSDCGAMTAIATCQCMDHMPAVGHWLRYADSARVVNEARTHRSERERIDSMVRENVVAQLANLKTHPAVRLALEEGRLALHGWVYDIESGCIDAYDGATGRFVSLADHPGVRATPATLPVAA

SEQ ID NO: 796 - protein, 215 aa, Yersinia frederiksenii
  Carbonic anhydrase Yersinia frederiksenii ATCC 33461
MKEIIDGFLKFQRDAFPERAELFRSLATQQSPKTLFISCSDSRMVPELVTQREPGDLFVIRNAGNIVPSYGPEPGGISASVEYAVTALKVTDIVICGHSDCGAMTAIAKCHCLDHMPAVKHWLQYADSAKVVNESREYKNIHDKTISMVHENVVAQLANIQTHPSVRLALEEGRLTIHGWVYDIESGLISAFDRASRQFVSLAANPNVRAVPAHN

SEQ ID NO: 797 - protein, 219 aa, Pseudomonas entomophila
  Carbonic anhydrase Pseudomonas entomophila L48
MQDIIDGFLKFQRDAFPERVKLFKDLATQQSPRALFISCSDSRLVPELVTQREPGDLFVIRNAGNIVPSYGPEPGGVSASVEYAVAALQVADIVICGHSDCGAMTAIATCKCLDHMPAVAGWLRYADSARVVNEARQHQSPHAKVEAMVRENVIAQLANIQTHPSVRLALEEGRVALHGWIYDIESGRIDAFDGRTGQFVSLADNPEVRAVSHASRHVA

SEQ ID NO: 798 - protein, 219 aa, Pseudomonas putida
  Carbonate dehydratase Pseudomonas putida W619
MKAIIDGFLKFQKNAFPERVKLFKDLANQQAPKALFISCSDSRLVPELVTQREPGDLFVIRNAGNIVPSYGPEPGGVSASVEYAVAGLNVADIVICGHSDCGAMTAIATCKCLDHMPAVAGWLRYADSAKVVNEARHHVDKPSKVASMVRENVIAQLANIQTHPSVRLALEEGRVTLHGWIYDIETGGIDAFDGSTGTFVSLAENPEVHAVSQQARHVA

SEQ ID NO: 799 - protein, 217 aa, Serratia proteamaculans
  Carbonate dehydratase Serratia proteamaculans 568
MKEVIEGFLKFQREAFVERTALFQRLATQQSPRTLFISCSDSRLVPELITQREPGDLFVIRNAGNIVPSFGPEPGGVSASVEYAVSALGVEDIVICGHSDCGAMTAIATCQCLQHMPTVANWLRYADSAKVVNQAYQHASENEKVSSMVRENVIAQLNNIKTHPSVALALEQGRLKLHGWVYDIASGGIEALDGETRRFIPLATNPEVTATPAVSRF

SEQ ID NO: 800 - protein, 211 aa, Erwinia tasmaniensis
  Carbonate dehydratase Erwinia tasmaniensis Et1/99
MQHIVEGFLNFQKDIFPEQKELFRSLASSQNPKALFISCSDSRLVPELVTQQDPGQLFVIRNAGNIVPSFGPEPGGVSATIEYAVVALGVSDIVICGHSNCGAMKAIATCQCLAPMPAVEHWLRYADAAKAVVEKKNYDTEEDKVNAMVQENVIAQLNNIKTHPSVAVGLRNNALRLHGWVYDIESGAIRALDKDSKKFVLLSDNPQVHFE

SEQ ID NO: 801 - protein, 220 aa, Pseudomonas aeruginosa
  Carbonate dehydratase Pseudomonas aeruginosa PA7
MRDIIDGFLRFQRDAYPARSQLFKSLATRQAPKALFIACSDSRVVPELLTQREPGELFVIRNAGNIVPGYGPQPGGVSASVEYAVAVLGVADIVVCGHSDCGAMGAIASCACLDHLPAVAGWLRHAEAARAMNSAHEHSSDAARLDALVRHNVIAQLANLRTHPSVARALEQGRLNLHGWVYDIESGRIDALDGASRRFVSLAEHPGVRAVGGEPGQAVA

SEQ ID NO: 802 - protein, 202 aa, Streptosporangium roseum
  Carbonate dehydratase Streptosporangium roseum DSM 43021
MQDLEEGVARFQRDVFPAKTELFTRLATAHQPATLFISCSDARVVPELITQSEPGELFVIRTAGNLVPAYAPGSADGVAAGIEYAVAVLGVSDIVVCGHSGCGAMTAVADGLDPAALPAVAGWLRHADASRARVTTTETGTGEVAALVRQNVLTQLANLATHPSVAHALAGKTVTLHGWIYDIGTGTVAELDATGRPSALAV

SEQ ID NO: 803 - DNA, 3704 bp, Artificial Sequence
  Description of Artificial Sequence: Synthetic mcr codon optimized from C. aurantiacus
gaattccgctagcaggagctaaggaagctaaaatgtccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagctt

SEQ ID NO: 804 - DNA, 4911 bp, Artificial Sequence
  Description of Artificial Sequence: Synthetic pJ206 plasmid polynucleotide
ggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacttgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtcaccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatttttttttcctcctcggcgtttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggcgctgacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccatttttttttcctcctttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatttttttttcctcctttaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattgaggggtgtcgcccttgtcgctgagatatcgatatccgtcaaaagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgctta

SEQ ID NO: 805 - DNA, 298 bp, Artificial Sequence
  Description of Artificial Sequence: Synthetic P(talA) promoter based on E. coli
ggtcatccatttggttgttcctttcacgtaacgttcacaaataaagtgtgtgggcaacagcccctgcccacaacgtggcgcacattattaccctgccggagtctacagactttgagcaagtccaaactctcaccattaatataatgttttggtaataatcctataacactgatgttacctgcttaatccagcaataccatgcctgtctgctatgcttttttgatgcgtttagcgaaatttctcagaagtgtgaattaacgcactcatctaacactttacttttcaaggagtatttccc

SEQ ID NO: 806 - DNA, 5794 bp, Artificial Sequence
  Description of Artificial Sequence: Synthetic plasmid pSMART(HC)Amp-PtalA-mcr
ggtcatccatttggttgttcctttcacgtaacgttcacaaataaagtgtgtgggcaacagcccctgcccacaacgtggcgcacattattaccctgccggagtctacagactttgagcaagtccaaactctcaccattaatataatgttttggtaataatcctataacactgatgttacctgcttaatccagcaataccatgcctgtctgctatgcttttttgatgcgtttagcgaaatttctcagaagtgtgaattaacgcactcatctaacactttacttttcaaggagtatttcccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaagacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagtttacgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatctcacggatggcatgacagtaagagaattatgcagtgctgccataaccatgagtgataacactgcggccaacttacttctggcaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggatcacttctgcgctcggccctcccggctggctggtttattgctgataaatctggagccggtgagcgtgggtctcgcggtatcattgcagcactggggccagatggtaagccctcccgcatcgtagttatctacacgacggggagtcaggcaactatggatgaacgaaatagacagatcgctgagataggtgcctcactgattaagcattggtaatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgtt

SEQ ID NO: 807 - DNA, 27 bp, Artificial Sequence
  Description of Artificial Sequence: Synthetic Primer 1
gggaaccatggcaattggcataccaag

SEQ ID NO: 808 - DNA, 28 bp, Artificial Sequence
  Description of Artificial Sequence: Synthetic Primer 2
gggttacagagctttcaggattgcatcc

SEQ ID NO: 809 - DNA, 26 bp, Artificial Sequence
  Description of Artificial Sequence: Synthetic Primer 3
gggaacggcggggaaaaacaaacgtt

SEQ ID NO: 810 - DNA, 30 bp, Artificial Sequence
  Description of Artificial Sequence: Synthetic Primer 4
ggtccatggtaattctccacgcttataagc

SEQ ID NO: 811 - DNA, 2404 bp, Artificial Sequence; identical to SEQ ID NO: 7
  Description of Artificial Sequence: Synthetic pBT-3 vector polynucleotide

SEQ ID NO: 812 - DNA, 21 bp, Artificial Sequence
  Description of Artificial Sequence: Synthetic Primer 7
aacgaattcaagcttgatatc

SEQ ID NO: 813 - DNA, 21 bp, Artificial Sequence
  Description of Artificial Sequence: Synthetic Primer 8
gaattcgttgacgaattctct

SEQ ID NO: 814 - DNA, 24 bp, Artificial Sequence
  Description of Artificial Sequence: Synthetic Primer 9
ggaaacagctatgaccatgattac

SEQ ID NO: 815 - DNA, 26 bp, Artificial Sequence
  Description of Artificial Sequence: Synthetic Primer 10
ttgtaaaacgacggccagtgagcgcg

SEQ ID NO: 816 - DNA, 5592 bp, Artificial Sequence
  Description of Artificial Sequence: Synthetic pBT-3 -- PtiA:pntAB plasmid polynucleotide
aacgaattcaagcttgatatccactgtggaattcgcccttttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcattgatctcgtccatttccagcacgatgtcatacggtacttttgcttcagccagcaatacgttcatatgtccaggcaaacgccccgcgaccgggtggataccgaaacgcacattaataccacgagcgcgcaatttctcagtaatttcagcgacaggatattgcgcctgcgcgactgccatgccgtaccccggagtaatgatcactgaatgggagtttttcagcagttccgctgtctcttctgcggtgatttcgcggtgctcacccacttcctgatcatcgccagtagaagagccgtcggtgccgaaaccacccgcaataacgctgataaaggaacggttcatcgccttacacataatgtaagaaaggatagcccccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaattgcggtcattatcagcaatgccagcacttgcaggccgacgctgtccgtgcgaacaaatacaatcagcagcaggaaggaaacgaccagagccgccaggttcattttgtgacggtttggcagcatcaatggtttagacgaaatcttgccacacagtttgccgaacgccaccaccgaacccgtgaacgttaccgccccgatgaagataccgaggaacacttccgtcaggtgaatattgaccagaatcggtgccattcccgcgtcatgatgcagatagctgttaaagccaaccagcactgccgccagacccacgaagctatgcaggatcgccaccagttctggcatttcggtcatttcaactttcttcgccagacggataccaattgccccaccaatgaccatcgccagcaagatccagccaacattacccgtatccggtccaaaaatggttgcgattaacgcaatcgccatcccggcgataccgaagttgttaccctggcgagacgtttcatgtttcgaaagaccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaaaacggtgaagtgcccaaggaattctttcggcgcaacgcttgccatccagccaaaaagaatgattgccagcgccatcaacgcgtatttacgccacggtgagcaggtacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatattgccgtctttctctttgcacaacagtttcagcagattaacgaggtttgtgccgtaaagctgtgaggattgcgtcggcagacggcccggaagatcggtataaccaatcactttgacaccattttccgtagtgaagatttcacccggcacggtgtattcacagttgccgccgttttgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcgccgctgccagcttcctctttaaaatccagctcgaggaattccgcgcccatactttgaacttgttctttcacttccgggcgggtgtcgaatgcacgcacaatcgcgccgagactgtttgctgcgccaatggcggccagacctgcaacacccgcaccaatcaccatcacttttgccggtggcactttcccggccgcagtaatttgcccggtaaagaagcgcccaaattcatgtgccgcttcaacaatggcgcgataaccggcgatgttcgccatcgagcttagtgcgtccagcgattgtgcgcgtgagatacgcggcacagagtccatcgccatcacggtcacgttacgttccgcaagtttttgcattaattccggattctgcgcaggccagataaaactcaccagcgttgtcccaggattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattcgcattttaattctccacgcttataagcgaataaaggaagatggccgccccgcagggcagcaggtctgtgaaacagtatagagattcatcggcacaaaggctttgctttttgtcatttattcaaaccaagggcgaattccacattggtcgctgcagcccgggggatccactagttctagagcggccgcaccgcgggagctagagaattcgtcaacgaattcaacgaattcaagcttgatatcattcaggacgagcctcagactccagcgtaactggactgaaaacaaactaaagcgcccttgtggcgctttagttttgttccgcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagtacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaacgcgtggatccccctcaagtcaaaagcctccggtcggaggcttttgactttctgctatggaggtcaggtatgatttaaatggtcagtattgagcgatatctagagaattcgtc

SEQ ID NO: 817 - DNA, 7263 bp, Artificial Sequence
  Description of Artificial Sequence: Synthetic pj251:26385 plasmid polynucleotide
gcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagggaagttcctattctctagaaagtataggaacttctgaaggggggacagctgtctcaaatgtctcggaatcgctgacgattcccaggtttctccggcaagcatagcgcatggcgtctccatgcgagaatgtcgcgcttgccggataaaaggggagccgctatcggaatggacgcaagccacggccgcagcaggtgcggtcgagggcttccagccagttccagggcagatgtgccggcagaccctcccgctttgggggaggcgcaagccgggtccattcggatagcatctccccatgcaaagtgccggccagggcaatgcccggagccggttcgaggcgccggtttgaataaatgacaaaaagcaaagcctttgtgccgatgaatctctatactgtttcacagacctgctgccctgcggggcaggaggaaaaacatgtccctgaacttcctggacttcgagcagccgattgcagaactggaagcgaagattgacagcctgaccgcggttagccgtcaagatgagaaactggacattaacatcgacgaagaggtccaccgtttgcgtgagaagtctgttgaactgactcgcaaaatctttgctgatttgggcgcatggcagattgcccagttggctcgccacccacaacgcccatataccctggactacgtgcgcctggcgtttgacgagttcgacgaactggcaggcgaccgcgcctatgcggacgataaagcaattgtcggcggtattgctcgtttggatggccgtccggtgatgattatcggccatcaaaaaggccgcgagacgaaagaaaagattcgtcgtaactttggtatgccggcaccggagggctaccgcaaggccctgcgtctgatgcaaatggccgaacgctttaagatgccgattatcacgttcattgatacgccgggtgcgtacccaggcgttggtgcggaagagcgtggtcagagcgaggccatcgcacgtaacctgcgtgagatgtctcgtctgggtgtgccggtcgtttgcaccgtgattggcgagggcggtagcggtggtgcgttggcgatcggtgtcggtgataaggtcaacatgctgcaatacagcacgtacagcgtcattagcccggaaggttgcgcttccattctgtggaagagcgcggataaagcaccattggcagcggaagcgatgggtatcatcgcaccgcgtctgaaagaactgaagttgattgattctatcatcccggaaccgctgggcggtgctcaccgtaatccggaggcgatggcagccagcctgaaggcccagctgctggcggacctggcggatctggacgtgctgagcacggaggatctgaaaaaccgtcgctatcagcgcttgatgagctatggctacgcgtagtaaaggaggaaaatcatgagctggattgaacgcattaagtccaatatcaccccgacccgcaaggcgagcatccctgaaggcgtctggaccaaatgcgatagctgcggtcaggttttgtatcgtgcggagctggagcgtaacctggaagtgtgcccgaaatgcgaccatcacatgcgtatgaccgctcgtaatcgtctgcatagcctgctggatgagggcagcctggtcgagctgggtagcgaactggaaccgaaagatgttctgaaattccgtgattccaagaagtataaggatcgtttggcatctgcacaaaaagaaaccggtgagaaggacgcactggttgttatgaaaggcaccctgtatggtatgccggttgttgctgcggcgttcgagtttgcgtttatgggtggcagcatgggttccgtggtgggcgcacgctttgtgcgtgccgtggagcaggcgctggaggataactgtcctctgatttgtttcagcgcgagcggtggtgcgcgtatgcaagaggccctgatgagcctgatgcagatggcaaaaacctcggcagccctggcgaagatgcaagaacgcggcctgccgtacatttccgtcctgaccgaccctacgatgggcggtgtcagcgccagctttgcgatgctgggtgatttgaacatcgcagagccgaaggctctgattggttttgctggtccgcgtgttattgaacagacggttcgcgaaaagttgccgcctggtttccagcgcagcgagttcctgattgagaaaggtgccatcgacatgatcgttcgccgtccagaaatgcgtctgaaactggcgagcattctggcgaaattgatgaatctgccggctccgaatcctgaagcaccgcgtgagggtgtcgtggttccgccggtcccggaccaagagccggaggcataatagcacgtggagttaaccacgcggcttgccaacggggtctgaatcgctttttttgtatataatgcgtgtgaaatttcataccacaggcgaaggaggaaaaaccatggacattcgtaagatcaagaaactgattgaactggttgaagaaagcggcatcagcgagctggagatcagcgaaggtgaagagagcgtccgtatttcccgtgcggcaccggcagcgagctttccggttatgcagcaagcatacgccgctccgatgatgcaacagccggcacagagcaacgccgctgcaccggcgaccgttccaagcatggaggcaccggcagcggccgagatttcgggtcatatcgtgcgtagcccgatggtgggcaccttctatcgcacgccgtcgccggacgcaaaagccttcatcgaagtcggccagaaggtcaatgtcggcgacacgctgtgtatcgttgaggcaatgaaaatgatgaaccagattgaagcggataagagcggtactgttaaagcgatcctggtggaatccggccagcctgttgagttcgatgaaccgctggttgtgatcgagtaacgaggcgaacatgttggacaagatcgtgattgcaaaccgcggtgaaatcgcgctgcgtatcttgcgcgcgtgtaaagagctgggcattaagactgttgccgtgcattccagcgcagaccgcgacctgaagcatgttctgctggccgacgaaacggtttgcatcggtccggcaccgagcgtgaaaagctatctgaacatcccggccatcatctctgcggcagagatcaccggtgcagtggcgattcatccgggctacggtttcctgagcgagaacgctaactttgctgaacaagtggagcgtagcggtttcatcttcattggccctaaggcggagacgattcgcctgatgggcgacaaagtgagcgccattgcagcgatgaaaaaggccggtgtgccgtgtgttccgggcagcgatggtccgctgggtgacgatatggacaagaaccgtgccatcgctaaacgtattggctacccggtcattatcaaagcctctggtggtggcggtggccgtggtatgcgtgtcgtccgtggtgatgcggaactggcgcaaagcatcagcatgacccgtgcggaagccaaagcggcgttctctaacgatatggtgtatatggagaagtatctggagaatccgcgccacgttgaaatccaagttctggcggatggtcagggcaatgcgatctacttggcagaacgtgattgctccatgcaacgccgtcatcagaaggtggtggaagaggcaccggctccgggtattacgccggaactgcgtcgctacatcggtgagcgctgtgcgaaagcgtgtgtggacattggttaccgtggtgcgggtacgtttgagttcctgttcgaaaatggtgagttttacttcattgaaatgaatacccgcatccaggttgagcacccggtgaccgagatgattactggcgttgatctgatcaaagagcaactgcgcattgcggctggtcagccgctgtcgatcaagcaagaagaggtgcacgttcgtggtcacgcggtcgagtgccgtatcaatgcggaggacccgaatacctttctgccgagccctggtaagatcacgcgttttcacgcgccaggtggttttggcgttcgttgggagtctcacatctacgccggttacaccgtgccgccgtactatgacagcatgattggtaaactgatctgctatggcgaaaatcgtgatgtcgcgatcgcccgcatgaaaaacgcgctgcaagagctgatcattgatggcattaagaccaatgtggatttgcagatccgcattatgaacgacgagaatttccagcacggcggtacgaacattcactacctggaaaagaaactgggcctgcaagagaaataatagggtaccctagcataaccccttggggcctctaaacgggtcttgaggggttttttgaatcccccgggatgtctatcttaaggtagccaaagtttaaactttggctaccttaagatagacatactgccggcctggttcaaccagtcggcagccggcgctggcgcccgcgtattgcggtgcagccagcgcggcgcacaaggcggcgggcgtttcgtttcgccgcccgtttcgcgggccgtcaaggcccgcgaatcgtttctgcccgcgcggcattcctcgctttttgcgccaattcaccgggttttccttaagccccgtcgcttttcttagtgccttgttgggcatagaatcagggcagcggcgcagccagcaccatgttcgtgcagcgcggccctcgcgggggcgaggctgcagacagctgtcaaaatgaagggaagttcctatactttctagagaataggaacttctatagggagtcgaataagggcgacacaaaaggtattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccaggatgcctggcagttccctactctcgccgctgcgctcggtcgttcggctgcgggacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaa

SEQ ID NO: 818 - DNA, 22 bp, Artificial Sequence
  Description of Artificial Sequence: Synthetic pcr Primer 1
gcggggcaggaggaaaaacatg

SEQ ID NO: 819 - DNA, 45 bp, Artificial Sequence
  Description of Artificial Sequence: Synthetic Primer 1
gcttataagcgaataaaggaagatggccgccccgcagggcagcag

SEQ ID NO: 820 - DNA, 7298 bp, Artificial Sequence
  Description of Artificial Sequence: Synthetic pJ251:PtpiA:accAD-PrpiA:accBC polynucleotide
gcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagggaagttcctattctctagaaagtataggaacttctgaaggggggacagctgtctcaaatgtctcggaatcgctgacgattcccaggtttctccggcaagcatagcgcatggcgtctccatgcgagaatgtcgcgcttgccggataaaaggggagccgctatcggaatggacgcaagccacggccgcagcaggtgcggtcgagggcttccagccagttccagggcagatgtgccggcagaccctcccgctttgggggaggcgcaagccgggtccattcggatagcatctccccatgcaaagtgccggccagggcaatgcccggagccggttcgaggcgccggtttgaataaatgacaaaaagcaaagcctttgtgccgatgaatctctatactgtttcacagacctgctgccctgcggggcggccatcttcctttattcgcttataagcgcggggcaggaggaaaaacatgtccctgaacttcctggacttcgagcagccgattgcagaactggaagcgaagattgacagcctgaccgcggttagccgtcaagatgagaaactggacattaacatcgacgaagaggtccaccgtttgcgtgagaagtctgttgaactgactcgcaaaatctttgctgatttgggcgcatggcagattgcccagttggctcgccacccacaacgcccatataccctggactacgtgcgcctggcgtttgacgagttcgacgaactggcaggcgaccgcgcctatgcggacgataaagcaattgtcggcggtattgctcgtttggatggccgtccggtgatgattatcggccatcaaaaaggccgcgagacgaaagaaaagattcgtcgtaactttggtatgccggcaccggagggctaccgcaaggccctgcgtctgatgcaaatggccgaacgctttaagatgccgattatcacgttcattgatacgccgggtgcgtacccaggcgttggtgcggaagagcgtggtcagagcgaggccatcgcacgtaacctgcgtgagatgtctcgtctgggtgtgccggtcgtttgcaccgtgattggcgagggcggtagcggtggtgcgttggcgatcggtgtcggtgataaggtcaacatgctgcaatacagcacgtacagcgtcattagcccggaaggttgcgcttccattctgtggaagagcgcggataaagcaccattggcagcggaagcgatgggtatcatcgcaccgcgtctgaaagaactgaagttgattgattctatcatcccggaaccgctgggcggtgctcaccgtaatccggaggcgatggcagccagcctgaaggcccagctgctggcggacctggcggatctggacgtgctgagcacggaggatctgaaaaaccgtcgctatcagcgcttgatgagctatggctacgcgtagtaaaggaggaaaatcatgagctggattgaacgcattaagtccaatatcaccccgacccgcaaggcgagcatccctgaaggcgtctggaccaaatgcgatagctgcggtcaggttttgtatcgtgcggagctggagcgtaacctggaagtgtgcccgaaatgcgaccatcacatgcgtatgaccgctcgtaatcgtctgcatagcctgctggatgagggcagcctggtcgagctgggtagcgaactggaaccgaaagatgttctgaaattccgtgattccaagaagtataaggatcgtttggcatctgcacaaaaagaaaccggtgagaaggacgcactggttgttatgaaaggcaccctgtatggtatgccggttgttgctgcggcgttcgagtttgcgtttatgggtggcagcatgggttccgtggtgggcgcacgctttgtgcgtgccgtggagcaggcgctggaggataactgtcctctgatttgtttcagcgcgagcggtggtgcgcgtatgcaagaggccctgatgagcctgatgcagatggcaaaaacctcggcagccctggcgaagatgcaagaacgcggcctgccgtacatttccgtcctgaccgaccctacgatgggcggtgtcagcgccagctttgcgatgctgggtgatttgaacatcgcagagccgaaggctctgattggttttgctggtccgcgtgttattgaacagacggttcgcgaaaagttgccgcctggtttccagcgcagcgagttcctgattgagaaaggtgccatcgacatgatcgttcgccgtccagaaatgcgtctgaaactggcgagcattctggcgaaattgatgaatctgccggctccgaatcctgaagcaccgcgtgagggtgtcgtggttccgccggtcccggaccaagagccggaggcataatagcacgtggagttaaccacgcggcttgccaacggggtctgaatcgctttttttgtatataatgcgtgtgaaatttcataccacaggcgaaggaggaaaaaccatggacattcgtaagatcaagaaactgattgaactggttgaagaaagcggcatcagcgagctggagatcagcgaaggtgaagagagcgtccgtatttcccgtgcggcaccggcagcgagctttccggttatgcagcaagcatacgccgctccgatgatgcaacagccggcacagagcaacgccgctgcaccggcgaccgttccaagcatggaggcaccggcagcggccgagatttcgggtcatatcgtgcgtagcccgatggtgggcaccttctatcgcacgccgtcgccggacgcaaaagccttcatcgaagtcggccagaaggtcaatgtcggcgacacgctgtgtatcgttgaggcaatgaaaatgatgaaccagattgaagcggataagagcggtactgttaaagcgatcctggtggaatccggccagcctgttgagttcgatgaaccgctggttgtgatcgagtaacgaggcgaacatgttggacaagatcgtgattgcaaaccgcggtgaaatcgcgctgcgtatcttgcgcgcgtgtaaagagctgggcattaagactgttgccgtgcattccagcgcagaccgcgacctgaagcatgttctgctggccgacgaaacggtttgcatcggtccggcaccgagcgtgaaaagctatctgaacatcccggccatcatctctgcggcagagatcaccggtgcagtggcgattcatccgggctacggtttcctgagcgagaacgctaactttgctgaacaagtggagcgtagcggtttcatcttcattggccctaaggcggagacgattcgcctgatgggcgacaaagtgagcgccattgcagcgatgaaaaaggccggtgtgccgtgtgttccgggcagcgatggtccgctgggtgacgatatggacaagaaccgtgccatcgctaaacgtattggctacccggtcattatcaaagcctctggtggtggcggtggccgtggtatgcgtgtcgtccgtggtgatgcggaactggcgcaaagcatcagcatgacccgtgcggaagccaaagcggcgttctctaacgatatggtgtatatggagaagtatctggagaatccgcgccacgttgaaatccaagttctggcggatggtcagggcaatgcgatctacttggcagaacgtgattgctccatgcaacgccgtcatcagaaggtggtggaagaggcaccggctccgggtattacgccggaactgcgtcgctacatcggtgagcgctgtgcgaaagcgtgtgtggacattggttaccgtggtgcgggtacgtttgagttcctgttcgaaaatggtgagttttacttcattgaaatgaatacccgcatccaggttgagcacccggtgaccgagatgattactggcgttgatctgatcaaagagcaactgcgcattgcggctggtcagccgctgtcgatcaagcaagaagaggtgcacgttcgtggtcacgcggtcgagtgccgtatcaatgcggaggacccgaatacctttctgccgagccctggtaagatcacgcgttttcacgcgccaggtggttttggcgttcgttgggagtctcacatctacgccggttacaccgtgccgccgtactatgacagcatgattggtaaactgatctgctatggcgaaaatcgtgatgtcgcgatcgcccgcatgaaaaacgcgctgcaagagctgatcattgatggcattaagaccaatgtggatttgcagatccgcattatgaacgacgagaatttccagcacggcggtacgaacattcactacctggaaaagaaactgggcctgcaagagaaataatagggtaccctagcataaccccttggggcctctaaacgggtcttgaggggttttttgaatcccccgggatgtctatcttaaggtagccaaagtttaaactttggctaccttaagatagacatactgccggcctggttcaaccagtcggcagccggcgctggcgcccgcgtattgcggtgcagccagcgcggcgcacaaggcggcgggcgtttcgtttcgccgcccgtttcgcgggccgtcaaggcccgcgaatcgtttctgcccgcgcggcattcctcgctttttgcgccaattcaccgggttttccttaagccccgtcgcttttcttagtgccttgttgggcatagaatcagggcagcggcgcagccagcaccatgttcgtgcagcgcggccctcgcgggggcgaggctgcagacagctgtcaaaatgaagggaagttcctatactttctagagaataggaacttctatagggagtcgaataagggcgacacaaaaggtattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccaggatgcctggcagttccctactctcgccgctgcgctcggtcgttcggctgcgggacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaa

SEQ ID NO: 821 - DNA, 17 bp, Artificial Sequence
  Description of Artificial Sequence: Synthetic pcr Primer FW043
atgggttttctttccgg

SEQ ID NO: 822 - DNA, 19 bp, Artificial Sequence
  Description of Artificial Sequence: Synthetic pcr Primer FW047
ttatttcagttcgagttcg

SEQ ID NO: 823 - DNA, 21 bp, Artificial Sequence
  Description of Artificial Sequence: Synthetic pcr Primer FW044
ctatccatcgcctacggtatc

SEQ ID NO: 824 - DNA, 18 bp, Artificial Sequence
  Description of Artificial Sequence: Synthetic pcr Primer FW045
cgttgcaatggcaaaagc

SEQ ID NO: 825 - DNA, 18 bp, Artificial Sequence
  Description of Artificial Sequence: Synthetic pcr Primer FW046
cggcggtttcagcattgc

SEQ ID NO: 826 - protein, 359 aa, Sulfolobus tokodaii
MILMRRTLKAAILGATGLVGIEYVRMLSNHPYIKPAYLAGKGSVGKPYGEVVRWQTVGQVPKEIADMEIKPTDPKLMDDVDIIFSPLPQGAAGPVEEQFAKEGFPVISNSPDHRFDPDVPLLVPELNPHTISLIDEQRKRREWKGFIVTTPLCTAQGAAIPLGAIFKDYKMDGAFITTIQSLSGAGYPGIPSLDVVDNILPLGDGYDAKTIKEIFRILSEVKRNVDEPKLEDVSLAATTHRIATIHGHYEVLYVSFKEETAAEKVKETLENFRGEPQDLKLPTAPSKPIIVMNEDTRPQVYFDRWAGDIPGMSVVVGRLKQVNKRMIRLVSLIHNTVRGAAGGGILAAELLVEKGYIEK

SEQ ID NO: 827 - DNA, 780 bp, Escherichia coli
atgggttttctttccggtaagcgcattctggtaaccggtgttgccagcaaactatccatcgcctacggtatcgctcaggcgatgcaccgcgaaggagctgaactggcattcacctaccagaacgacaaactgaaaggccgcgtagaagaatttgccgctcaattgggttctgacatcgttctgcagtgcgatgttgcagaagatgccagcatcgacaccatgttcgctgaactggggaaagtttggccgaaatttgacggtttcgtacactctattggttttgcacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcgcgctatcccgaactacaacgttatgggtctggcaaaagcgtctctggaagcgaacgtgcgctatatggcgaacgcgatgggtccggaaggtgtgcgtgttaacgccatctctgctggtccgatccgtactctggcggcctccggtatcaaagacttccgcaaaatgctggctcattgcgaagccgttaccccgattcgccgtaccgttactattgaagatgtgggtaactctgcggcattcctgtgctccgatctctctgccggtatctccggtgaagtggtccacgttgacggcggtttcagcattgctgcaatgaacgaactcgaa

SEQ ID NO: 828 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 829 - DNA, 21 bp, Artificial Sequence
  Description of Artificial Sequence: Synthetic primer
gagcacagtatcgcaaacatg

SEQ ID NO: 830 - DNA, 18 bp, Artificial Sequence
  Description of Artificial Sequence: Synthetic primer
ctgccagcctggaaaaag

SEQ ID NO: 831 - DNA, 20 bp, Artificial Sequence
  Description of Artificial Sequence: Synthetic primer
tctatgggttgcggttgaat

SEQ ID NO: 832 - DNA, 23 bp, Artificial Sequence
  Description of Artificial Sequence: Synthetic primer
tgagactgactgttaataagcgc

SEQ ID NO: 833 - DNA, 23 bp, Artificial Sequence
  Description of Artificial Sequence: Synthetic primer
tagttttattgggtgtccggccc

SEQ ID NO: 834 - DNA, 23 bp, Artificial Sequence
  Description of Artificial Sequence: Synthetic primer
agcagcttataacgccggaccag

SEQ ID NO: 835 - DNA, 23 bp, Artificial Sequence
  Description of Artificial Sequence: Synthetic primer
tggaactattggccaaactaatg

SEQ ID NO: 836 - DNA, 23 bp, Artificial Sequence
  Description of Artificial Sequence: Synthetic primer
cgttgattttccggcagaagtca

SEQ ID NO: 837 - DNA, 16 bp, Artificial Sequence
  Description of Artificial Sequence: Synthetic primer
gcgcccatacgcccac

SEQ ID NO: 838 - DNA, 21 bp, Artificial Sequence
  Description of Artificial Sequence: Synthetic primer
gccgtgggcgaaaaacggctt

SEQ ID NO: 839 - DNA, 70 bp, Artificial Sequence
  Description of Artificial Sequence: Synthetic primer
cgtgcataacgtgttgggttcataaaacattaatttcggtttcgggtgacgtgtaggctggagctgcttc

SEQ ID NO: 840 - DNA, 75 bp, Artificial Sequence
  Description of Artificial Sequence: Synthetic primer
ggctccctgacgtttttttagccacgtatcaattataggtacttccatgtcgagtgtgtaggctggagctgcttc

SEQ ID NO: 841 - DNA, 24 bp, Artificial Sequence
  Description of Artificial Sequence: Synthetic primer
aatcttgcttacgccacctggaag

SEQ ID NO: 842 - DNA, 25 bp, Artificial Sequence
  Description of Artificial Sequence: Synthetic primer
caggcagcgcatcaggcagccctgg

SEQ ID NO: 843 - DNA, 20 bp, Artificial Sequence
  Description of Artificial Sequence: Synthetic primer
ccattacctcaacggcaaaa

SEQ ID NO: 844 - DNA, 20 bp, Artificial Sequence
  Description of Artificial Sequence: Synthetic primer
aagcaataacgttccggttg

SEQ ID NO: 845 - DNA, 20 bp, Artificial Sequence
  Description of Artificial Sequence: Synthetic primer
gcgctgattggcacacctga

SEQ ID NO: 846 - DNA, 28 bp, Artificial Sequence
  Description of Artificial Sequence: Synthetic primer
attgaaaggttggtgcaacagcatgttg

SEQ ID NO: 847 - DNA, 24 bp, Artificial Sequence
  Description of Artificial Sequence: Synthetic primer
tggtcccgtgatgtcgcgttatac

SEQ ID NO: 848 - DNA, 20 bp, Artificial Sequence
  Description of Artificial Sequence: Synthetic primer
gaactggcgaagaaagtgga

SEQ ID NO: 849 - DNA, 21 bp, Artificial Sequence
  Description of Artificial Sequence: Synthetic primer
tgccgaagaggtgaataacgc

SEQ ID NO: 850 - DNA, 20 bp, Artificial Sequence
  Description of Artificial Sequence: Synthetic primer
atcatgctgccgagcatacg

SEQ ID NO: 851 - DNA, 22 bp, Artificial Sequence
  Description of Artificial Sequence: Synthetic primer
ctccccagtcgatattctcgtg

SEQ ID NO: 852 - DNA, 70 bp, Artificial Sequence
  Description of Artificial Sequence: Synthetic primer
ttaccgctattgctgaaggtcgtcgttaatcacaaagcgggtcgcccttgcatatgaatatcctccttag

SEQ ID NO: 853 - DNA, 75 bp, Artificial Sequence
  Description of Artificial Sequence: Synthetic primer
ttccggttcagatatccgcagcgcaaagctgcggatgatgacgagattactgctgcatatgaatatcctccttag

SEQ ID NO: 854 - DNA, 23 bp, Artificial Sequence
  Description of Artificial Sequence: Synthetic primer
gcaaatagttgtgcagagggcgg

SEQ ID NO: 855 - DNA, 21 bp, Artificial Sequence
  Description of Artificial Sequence: Synthetic primer
ccagtggggagctacattctc

SEQ ID NO: 856 - DNA, 24 bp, Artificial Sequence
  Description of Artificial Sequence: Synthetic primer
cgtcattcagatgctggcgcgatc

SEQ ID NO: 857 - DNA, 17 bp, Artificial Sequence
  Description of Artificial Sequence: Synthetic primer
atgggttttctttccgg

SEQ ID NO: 858 - DNA, 80 bp, Artificial Sequence
  Description of Artificial Sequence: Synthetic primer
caggtttgcggcgtccagcggttatgtaactactattcggcgcgacttacgccgctccccgctcgcgataatgtggtagc

SEQ ID NO: 859 - DNA, 80 bp, Artificial Sequence
  Description of Artificial Sequence: Synthetic primer
aataaaaccaatgatttggctaatgatcacacagtcccaggcagtaagaccgacgtcattctatcatgccataccgcgaa

SEQ ID NO: 860 - DNA, 21 bp, Artificial Sequence
  Description of Artificial Sequence: Synthetic primer
gagataagcctgaaatgtcgc

SEQ ID NO: 861 - DNA, 21 bp, Artificial Sequence
  Description of Artificial Sequence: Synthetic primer
cagtccagttacgctggagtc

SEQ ID NO: 862 - DNA, 26 bp, Artificial Sequence
  Description of Artificial Sequence: Synthetic primer
actgaccatttaaatcatacctgacc

SEQ ID NO: 863 - DNA, 1207 bp, Artificial Sequence
  Description of Artificial Sequence: Synthetic polynucleotide
cagtccagttacgctggagtctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagtcgtgaagagagccgccgtgagcgttctctgcgtcgtctggagcaacgaaagaattagtgtttaaacataacttcgtatagcatacattatacgaagttattgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaataacttcgtatagcatacattatacgaagttatagatcttaactacttaaaaatttcagttgcttaatcctacaattcttgatataatattctcatagtttgaaagaactattcagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggactgaccatttaaatcatacctgacc

SEQ ID NO: 864 - DNA, 1290 bp, Artificial Sequence
  Description of Artificial Sequence: Synthetic polynucleotide
cagtccagttacgctggagtcgtaactgtctgcgtcatttttcatatcacattccttaagccaattttaatcctgctcaaatgaccgtctatgcttaaaaaacagccgtatcagcatcattactactgaagcaactgaattgtataagttaatttaatgttaagtagtgattcgtgccggggcgatgtctcgttttacccgaccgtcgaagacaattatcagtctttatccggcgttctaaggtgtttatcccactatcacggctgaatcgttaatattttgcgagttcacgccgaaatactgatttttggcgctagatcagtttaaacataacttcgtatagcatacattatacgaagttattgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataacttcgtatagcatacattatacgaagttatagatcttaactacttaaaaatttcagttgcttaatcctacaattcttgatataatattctcatagtttgaaagaactattcaaccgatggaagggaatatcatgcgaattggcataccaagagaacggttaaccaatgaaacccgtgttgcagcaacgccaaaaacagtggaacagctgctgaaactgggttttaccgtcgcggtagagagcggcgcgggtcaactggcaagttttgacgataaagcgtttgtgcaagcgggcgctgaaattgtagaagggaatagcgtctggcagtcagagatcattctgaaggtcaatgcgccgttagatgatgaaattgcgttactgaatcctgggacaacgctggtgagttttatctggcctgcgcagaatccggaaactgaccatttaaatcatacctgacc

SEQ ID NO: 865 - DNA, 1210 bp, Artificial Sequence
  Description of Artificial Sequence: Synthetic polynucleotide
cagtccagttacgctggagtcggcactataccagagaatgaacatactggattgctccagtattgtgaatgaacggtaacgcaataaaacatatttactgcaattctttggccggttcttttacgtacagcggaaacctgccgcttaaacggagagtatcgtcgataaaaatccaataaaacgtcagggcaaaagtaagaaacagacaaagcaaaggccgctcaggatatagccagataaatgacggggatcaattggcttacccgcgataaaatgttaccattctgttgcttttatgtatgtttaaacataacttcgtatagcatacattatacgaagttattgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataacttcgtatagcatacattatacgaagttatagatcttaactacttaaaaatttcagttgcttaatcctacaattcttgatataatattctcatagtttgaaagaactattcaagaacaggtaagccctaccatgccacattcctacgattacgatgccatagtaataggttccggccccggcggcgaaggcgctgcaatgggcctggttaagcaaggtgcgcgcgtcgcagttatcgagcgttatcaaaatgttggcggcggttgcacccactggggcaccatcccgtcgaaagctctccgtcacgccgtcagccgcattatagaattcaatcaaaacccactttacagcgaccattcccgactgctccgcactgaccatttaaatcatacctgacc

SEQ ID NO: 866 - DNA, 1216 bp, Artificial Sequence
  Description of Artificial Sequence: Synthetic polynucleotide
cagtccagttacgctggagtcctctctcgacatatcaattattttcttgccgtggctgaacatggcagcttcacccgtgccgccagtgcgttgcacgtctcccaacctgcgctttcccagcagattcgccagttagaggagagtttaggcgtgccgctgtttgaccgtagcgggcgaacgattcgtctcactgatgcaggagaagtctggcgacagtacgccagccgggcgttacaggaactgggggcgggtaaacgggtttaaactaccgttcgtataatgtatgctatacgaagttatgatatctactacgacactgcatgcatcatcagatcttgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgcataacttcgtataatgtatgctatacgaacggtaagatcttaactacttaaaaatttcagttgcttaatcctacaattcttgatataatattctcatagtttgaaagaactattcaaaattaaagaggtatatattaatgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgactgaccatttaaatcatacctgacc

SEQ ID NO: 867 - DNA, 2172 bp, Artificial Sequence
  Description of Artificial Sequence: Synthetic polynucleotide
atggcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtc

SEQ ID NO: 868 - DNA, 2568 bp, Artificial Sequence
  Description of Artificial Sequence: Synthetic polynucleotide
atggctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtc

SEQ ID NO: 869 - DNA, 3135 bp, Artificial Sequence
  Description of Artificial Sequence: Synthetic polynucleotide
atggcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtc

SEQ ID NO: 870 - protein, 1217 aa, Erythrobacter sp.; identical to SEQ ID NO: 788
  Erythrobacter sp. NAP1

SEQ ID NO: 871 - DNA, 7999 bp, Artificial Sequence
  Description of Artificial Sequence: Synthetic polynucleotide
gtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatgagcaaagaaggtaatgcggccaaaggccgcctggagggtaaagtggccctgatcaccggtgcagctggcaacctgggtaatgaaattagccgcgcgtttgcccgtgagggtgcgttcgtggttatgaccggccgcacggaagaacgtatctctgcggcccgcgaacagctgattgcggataccggtgtcgccccggaacgtatcgacacggcggtgctggatggcggtaacccggactctattcgtgcagctatggccaaactgcgcaaagaatatggccgtattgatatcctgattaacaatgcaggttcagcaggtccgaaacagccgctgcataatgttccgctgtcgccgcaagaaatggaagcatgcggtgataccgaaacggtgcgcgacgcgatgctgaacatcctgggcgtgacctggaatatggctcgtattgttgcgccgatgatgccggtgggcggtgcaatggttaatatcagcaccatttttagccacacgcgctattacggccgtaccgcgtatgtcgtgccgaaagcggccctgaacgcactgagcaatcagctggcttctgaactgggcccgcgtggtattcgcgttaacaccgtctttccgggtccgatcgaaagtgatcgtattcgcacggtgttcgcagctatggatgaagttcagtcccaaccgaaagacaccacggcgaattactttaccggtcgtatggcactgacgcgtagcgtcaacggcaaagtggatggtaaaccgctgccgaatccgaaagacatcgcgggtacctgtctgttcctggccagtgaagaagcggccggcattgccggtgaagaagttgatgtcacccatggcctgtccgcaaaccgcacgtctgctagtacctatatgacgcgcccgtctatgcgtagtctggatggcgcgggtctgaacatcttcatcgtttcaggtgaaaactgggatgacgccctggtcgcagctcacaccctgatcggctcgggtgcaaaagtgcgcctgggcctggcacgtaacgctgatgttgcacaggctaatgcgcgtctgaaagcgcaaggcattggtgaagaactgaccgttacgcgttttaatcgcgccgaaccggacgcaatggaagatgctctggcggccttcagtggcgacgttgatggtgcgatcaccggcgccattatcctgccggtcaaaccgagcggtcattttacgggctctctgctggcagctgatgacgataccgtgacgaaattcatggataccgaactggtcggtgccattgcagtgtcccgttcactggcacgttactggcacggtcgtgaagatttgcagagcccgccgcgttgcgtttttatgaccaacccgggtgacccgctgggcaattccttcgcgtcagtgctgtcggccggtatcacgcagctgatccgtatttggcgcgatgaagaacgcgttcaagcaggcaacggtagtaccgaacatgcggtctggtccaatcagattgtgcgccacaccaacacggaagatgaaaatacccgttttgcaagcggccatgctacgcgcgtgctgttccgtgaacaacacatcgccgaaattgatctgaaactgccggcaaacatcagtgaagaaaccggttcccgcaaagcaatggtgggctttgctgaaaatattaccggtctgcatctgggcaaagttgcattcatcacgggcggtagtgctggtattggcggtcaggtggcacgtctgctggctctggcaggtgccaaagtgatgatggttgcacgtcgcgaatccgaactggtcgcggcacgtgatcgcatcgtgggtgaactgcaagacattggctttgcgggtgttgaacgtcgcgtcaaatatatggcggacattgatgtcagtgattttgcctccctggacaaagcggtggatgccaccctggaagaattcggccgtatcgactacctgattaacaatgcgggcgttgcaggtgctgaagacatggtcatcgatatggaaccggaagcctggcgcttcaccctggatgcaaacctgattagcaattatcatctgatgcagcgtgttgtcccgctgatgaaagaacaaggctctggttatgtcctgaacgtgagctcttactttggcggtgaaaaattcctggcggttgcctatccgaatcgcgccgattacggtctgagcaaagcgggccagcgtgccatggtggaagcattttctccgttcctgggcccggaagttcaatgcaacgcaattgctccgggtccggtcgacggtgatcgtctgtctggtaccggcggtaaaccgggcctgtttcagcgtcgcgcgaaactgatcctggaaaacaaacgcctgaatgctgtgtatagtgcggttatccatgccattcgtgaaggcggtgatgcagctaaaattctgacccgtctgagtcgcaattcgaccagcacgctgtcccacgatgcagaagcaccggaagaactgcgtaaactggcactggattttgctagccagggcgacggtctgtgtacctgggatcaatacctgctgacggacgcaatggctcagcgtctgctggtgcgtctgcaactgggcggttttctgctgggttcaaacgaatgggcctcgctgagttcctcagaacagacctggctgaaactgtcaccgccggacgataaaccgttcctgccggcggcccaagttgataaagtcgcgaatggcgtcggtaaaggcgtgatttcgcagctgcatctgggtgcaatgccgaccgaagccgaagttgcgcaagccacggtctttttcctggcagatcgcgctgtgtcaggtgaaacctttatgccgtcgggcggtctgcgtgttgaacgctcaaacaccgaacgcgaaatgttcggctcgccgaaacaggaacgtatcgataaaatgaaaggtaaaaccgtctggattatcggcgaacacctgagtgactatgtggcagctacgatcgaagaactggtgtccggttgcggcgttgcgaaagtggttctgattgccaaagataaaagcggtgaaaaagcggttcgtgaccagctgccgaatgacctgtctaaagatgcactggaagtgctgatcgctggtgatggcctggaagaagcgatggacgaagccctgggccattggggtaaaccgaccacggtgctgtcaatgccgggcgaaccgctgccggatcacctgtttgaaggcggtaacccgctgtcgaccaaagacttcgcacatatggtggaagctaatattacccgtcactatcgcgttacgcgtaaagcgtccctgtacgatggttgtcaggtcgtgctggttagcccggatgtcccgtacggttctgacggtccgggtgttgcactggctaactttgtcaaaacctctctgcatgcgttcaccgccacggtggcagttgaaaatgaacgcctggttcacgatgtcccggtgaaccagatcaatctgacgcgtcgcgtgtcgagcgaagaaccgcgtgacgcagatgaacatgctgaagaactgcgtcgctttacccgtgcagtgctgctggttggtgcaccgctgccggacgcacaggattcacgttatcgctcgaaaatttaccgcggcaccagcatgacggtgtaataaccgcggcacgagcatgacggtccatcaccatcatcactaatagagatctgcagctggtaccatatgggaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctg

SEQ ID NO: 872 - DNA, 7837 bp, Artificial Sequence
  Description of Artificial Sequence: Synthetic polynucleotide
catggctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggtcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaaggaggcggtatcattgcagcactggggccagatggtaagccctcccgtatcgtagttatctacacgacgggattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaagggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaac

SEQ ID NO: 873 - DNA, 7946 bp, Artificial Sequence
  Description of Artificial Sequence: Synthetic polynucleotide
gtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggtcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaaattaaagaggtggatccgagatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctg

SEQ ID NO: 874 - DNA, 7934 bp, Artificial Sequence
  Description of Artificial Sequence: Synthetic polynucleotide
catggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaac

SEQ ID NO: 875 - DNA, 8894 bp, Artificial Sequence
  Description of Artificial Sequence: Synthetic polynucleotide
ccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcgagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgg

SEQ ID NO: 876 - DNA, 11744 bp, Artificial Sequence
  Description of Artificial Sequence: Synthetic polynucleotide
ccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcgagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatcgtggcggctggcgttccttgtcgggttattcgcgaaataaacgaccgggataagcactattatttcaaagattataaagttgaatcgtcagtttaaattataaaaattgcctgatacgctgcgcttatcaggcctacaagttcagcgatctacattagccgcatccggcatgaacaaagcgcaggaacaagcgtcgcatcatgcctctttgacccacagctgcggaaaacgtactggtgcaaaacgcagggttatgatcatcagcccaacgacgcacagcgcatgaaatgcccagtccatcaggtaattgccgctgatactacgcagcacgccagaaaaccacggggcaagcccggcgatgataaaaccgattccctgcataaacgccaccagcttgccagcaatagccggttgcacagagtgatcgagcgccagcagcaaacagagcggaaacgcgccgcccagacctaacccacacaccatcgcccacaataccggcaattgcatcggcagccagataaagccgcagaaccccaccagttgtaacaccagcgccagcattaacagtttgcgccgatcctgatggcgagccatagcaggcatcagcaaagctcctgcggcttgcccaagcgtcatcaatgccagtaaggaaccgctgtactgcgcgctggcaccaatctcaatatagaaagcgggtaaccaggcaatcaggctggcgtaaccgccgttaatcagaccgaagtaaacacccagcgtccacgcgcggggagtgaataccacgcgaaccggagtggttgttgtcttgtgggaagaggcgacctcgcgggcgctttgccaccaccaggcaaagagcgcaacaacggcaggcagcgcccaccaggcgagtgtttgataccaggtttcgctatgttgaactaaccagggcgttatggcggcaccaagcccaccgccgcccatcagagccgcggaccacagccccatcaccagtggcgtgcgctgctgaaaccgccgtttaatcaccgaaggcatcaccgcctgaatgatgccgatccccaccccaccaagcagtgcgctgctaagcagcagcgcactttgcgggtaaagctcacgcatcaatgcaccgacggcaatcagcaacagactgatggcgacactgcgacgttcgctgacatgctgatgaagccagcttccggccagcgccagcccgcccatggtaaccaccggcagagcggtcaacagggcagccacgctaaagctcattccgctcgcctggcgcaattgcggtagcagtggcccgacggaggtgagcagtggtcgcatattaagaccaatcagcaccagtaccagcagcatcgtgaacgtcttttgatggttgcgcatggctgtcagaacggtttggtcggcagatatttaccatctaaggtgatgaccgcacgttcgccaccttccgggtccgccactttcttaacgtcgagtttgaagttaatcgcgctaataatgccatcgccaaatttctcatgaaccaacgctttcagggttgtaccgtacacctgcaacatttcatagaaacgatacatcgttgggtcagttggaatacggtcatcaatgcagccacgcagtggaatcatctgcaacagtagaatggagtcttcgtcgagatccagcttcgccccgaccaggcgggcggcgtcggcaggaagcgcctgctgacccagcaaagccgcggttacaaaggcttctgccagaccggtgccgtcggcaatctcggcaaatgagagatcttttttagctttgctgagcaaaatggcatcggcaagatcaagacgaatattgcggttaatttgtgactgaatcatggtggaactcctgatggtttaaaaataaggttacgctgcggtcggttggcgtagcggtatggcacaaacgcgaggattagcggccagtggcacaaactggcgggttgcgccgtcaaaagctgcgatgctgccgctttcaatgtcgtagacccagccgtgcagggcgatccgcccctcttcgagcgccaggcgcaccgatggatgagtttgcaaattagccaactgagcaatgacgttttcacgtaccatcgccgcagcttttgacggtaaatcggaatgcgggcgcgcctcattaacgacgcgggctgaatcggcataacgcagccagtgggagacggcaggcatatggtccatgcactgacagctggcaatggcggtcatcgcgccacagttggaatgaccacaaatcacaatgtcagatacccgaagcgcagcgacggcatactccaccgaagcagaaacgccaccgggttccggcccgtaggaagggacgatattgcccgcgttgcgaataacgaacagatcgccaggctcacgttgcgtcaccagctcagggaccagacggctgtcggagcaggagataaaaagtgtgcgcgggctttgctgtgtcgccagctgtttaaacaaggcttcccgcttcggaaatgcctcgcgctggaatttaaggaatccatcaataatctctttcaccgttaacctctgtctgtctctggaatgagaggcagactactcgccgattgtcataaggtaaaagtctcatttatgatgagttccattggatttacttataggttgcgaatgctctctcgacatatcaattattttcttgccgtggctgaacatggcagcttcacccgtgccgccagtgcgttgcacgtctcccaacctgcgctttcccagcagattcgccagttagaggagagtttaggcgtgccgctgtttgaccgtagcgggcgaacgattcgtctcactgatgcaggagaagtctggtatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgg

SEQ ID NO: 877 - DNA, 8145 bp, Artificial Sequence
  Description of Artificial Sequence: Synthetic polynucleotide
gcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattattgtaaaacgacggccagtgagcgcgcgtaatacgactcactatagggcgaattggagctcccgcggtgcggccgctctagaactagtggatcccccgggctgcagcgaccaatgtggaattcgcccttggcacgtgcgaagttcctattctctaggaaagtataggaacttcgaggcttttgacttgagggggatccacgcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgaagttcctatactttctagagaataggaacttcgcacgtgccaagggcgaattccacagtggatatcaagcttatcgataccgtcgacctcgagggggggcccggtacccagcttttgttccctttagtgagggttaattgcgcgcttggcgtaatcatggtcatagctgtttccatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagggaagttcctattctctagaaagtataggaacttctgaaggggggacagctgtctcaaatgtctcggaatcgctgacgattcccaggtttctccggcaagcatagcgcatggcgtctccatgcgagaatgtcgcgcttgccggataaaaggggagccgctatcggaatggacgcaagccacggccgcagcaggtgcggtcgagggcttccagccagttccagggcagatgtgccggcagaccctcccgctttgggggaggcgcaagccgggtccattcggatagcatctccccatgcaaagtgccggccagggcaatgcccggagccggttcgaggcgccggtttgaataaatgacaaaaagcaaagcctttgtgccgatgaatctctatactgtttcacagacctgctgccctgcggggcggccatcttcctttattcgcttataagcgcggggcaggaggaaaaacatgtccctgaacttcctggacttcgagcagccgattgcagaactggaagcgaagattgacagcctgaccgcggttagccgtcaagatgagaaactggacattaacatcgacgaagaggtccaccgtttgcgtgagaagtctgttgaactgactcgcaaaatctttgctgatttgggcgcatggcagattgcccagttggctcgccacccacaacgcccatataccctggactacgtgcgcctggcgtttgacgagttcgacgaactggcaggcgaccgcgcctatgcggacgataaagcaattgtcggcggtattgctcgtttggatggccgtccggtgatgattatcggccatcaaaaaggccgcgagacgaaagaaaagattcgtcgtaactttggtatgccggcaccggagggctaccgcaaggccctgcgtctgatgcaaatggccgaacgctttaagatgccgattatcacgttcattgatacgccgggtgcgtacccaggcgttggtgcggaagagcgtggtcagagcgaggccatcgcacgtaacctgcgtgagatgtctcgtctgggtgtgccggtcgtttgcaccgtgattggcgagggcggtagcggtggtgcgttggcgatcggtgtcggtgataaggtcaacatgctgcaatacagcacgtacagcgtcattagcccggaaggttgcgcttccattctgtggaagagcgcggataaagcaccattggcagcggaagcgatgggtatcatcgcaccgcgtctgaaagaactgaagttgattgattctatcatcccggaaccgctgggcggtgctcaccgtaatccggaggcgatggcagccagcctgaaggcccagctgctggcggacctggcggatctggacgtgctgagcacggaggatctgaaaaaccgtcgctatcagcgcttgatgagctatggctacgcgtagtaaaggaggaaaatcatgagctggattgaacgcattaagtccaatatcaccccgacccgcaaggcgagcatccctgaaggcgtctggaccaaatgcgatagctgcggtcaggttttgtatcgtgcggagctggagcgtaacctggaagtgtgcccgaaatgcgaccatcacatgcgtatgaccgctcgtaatcgtctgcatagcctgctggatgagggcagcctggtcgagctgggtagcgaactggaaccgaaagatgttctgaaattccgtgattccaagaagtataaggatcgtttggcatctgcacaaaaagaaaccggtgagaaggacgcactggttgttatgaaaggcaccctgtatggtatgccggttgttgctgcggcgttcgagtttgcgtttatgggtggcagcatgggttccgtggtgggcgcacgctttgtgcgtgccgtggagcaggcgctggaggataactgtcctctgatttgtttcagcgcgagcggtggtgcgcgtatgcaagaggccctgatgagcctgatgcagatggcaaaaacctcggcagccctggcgaagatgcaagaacgcggcctgccgtacatttccgtcctgaccgaccctacgatgggcggtgtcagcgccagctttgcgatgctgggtgatttgaacatcgcagagccgaaggctctgattggttttgctggtccgcgtgttattgaacagacggttcgcgaaaagttgccgcctggtttccagcgcagcgagttcctgattgagaaaggtgccatcgacatgatcgttcgccgtccagaaatgcgtctgaaactggcgagcattctggcgaaattgatgaatctgccggctccgaatcctgaagcaccgcgtgagggtgtcgtggttccgccggtcccggaccaagagccggaggcataatagcacgtggagttaaccacgcggcttgccaacggggtctgaatcgctttttttgtatataatgcgtgtgaaatttcataccacaggcgaaggaggaaaaaccatggacattcgtaagatcaagaaactgattgaactggttgaagaaagcggcatcagcgagctggagatcagcgaaggtgaagagagcgtccgtatttcccgtgcggcaccggcagcgagctttccggttatgcagcaagcatacgccgctccgatgatgcaacagccggcacagagcaacgccgctgcaccggcgaccgttccaagcatggaggcaccggcagcggccgagatttcgggtcatatcgtgcgtagcccgatggtgggcaccttctatcgcacgccgtcgccggacgcaaaagccttcatcgaagtcggccagaaggtcaatgtcggcgacacgctgtgtatcgttgaggcaatgaaaatgatgaaccagattgaagcggataagagcggtactgttaaagcgatcctggtggaatccggccagcctgttgagttcgatgaaccgctggttgtgatcgagtaacgaggcgaacatgttggacaagatcgtgattgcaaaccgcggtgaaatcgcgctgcgtatcttgcgcgcgtgtaaagagctgggcattaagactgttgccgtgcattccagcgcagaccgcgacctgaagcatgttctgctggccgacgaaacggtttgcatcggtccggcaccgagcgtgaaaagctatctgaacatcccggccatcatctctgcggcagagatcaccggtgcagtggcgattcatccgggctacggtttcctgagcgagaacgctaactttgctgaacaagtggagcgtagcggtttcatcttcattggccctaaggcggagacgattcgcctgatgggcgacaaagtgagcgccattgcagcgatgaaaaaggccggtgtgccgtgtgttccgggcagcgatggtccgctgggtgacgatatggacaagaaccgtgccatcgctaaacgtattggctacccggtcattatcaaagcctctggtggtggcggtggccgtggtatgcgtgtcgtccgtggtgatgcggaactggcgcaaagcatcagcatgacccgtgcggaagccaaagcggcgttctctaacgatatggtgtatatggagaagtatctggagaatccgcgccacgttgaaatccaagttctggcggatggtcagggcaatgcgatctacttggcagaacgtgattgctccatgcaacgccgtcatcagaaggtggtggaagaggcaccggctccgggtattacgccggaactgcgtcgctacatcggtgagcgctgtgcgaaagcgtgtgtggacattggttaccgtggtgcgggtacgtttgagttcctgttcgaaaatggtgagttttacttcattgaaatgaatacccgcatccaggttgagcacccggtgaccgagatgattactggcgttgatctgatcaaagagcaactgcgcattgcggctggtcagccgctgtcgatcaagcaagaagaggtgcacgttcgtggtcacgcggtcgagtgccgtatcaatgcggaggacccgaatacctttctgccgagccctggtaagatcacgcgttttcacgcgccaggtggttttggcgttcgttgggagtctcacatctacgccggttacaccgtgccgccgtactatgacagcatgattggtaaactgatctgctatggcgaaaatcgtgatgtcgcgatcgcccgcatgaaaaacgcgctgcaagagctgatcattgatggcattaagaccaatgtggatttgcagatccgcattatgaacgacgagaatttccagcacggcggtacgaacattcactacctggaaaagaaactgggcctgcaagagaaataatagggtaccctagcataaccccttggggcctctaaacgggtcttgaggggttttttgaatcccccgggatgtctatcttaaggtagccaaagtttaaactttggctaccttaagatagacatactgccggcctggttcaaccagtcggcagccggcgctggcgcccgcgtattgcggtgcagccagcgcggcgcacaaggcggcgggcgtttcgtttcgccgcccgtttcgcgggccgtcaaggcccgcgaatcgtttctgcccgcgcggcattcctcgctttttgcgccaattcaccgggttttccttaagccccgtcgcttttcttagtgccttgttgggcatagaatcagggcagcggcgcagccagcaccatgttcgtgcagcgcggccctcgcgggggcgaggctgcagacagctgtcaaaatgaagggaagttcctatactttctagagaataggaacttctatagggagtcgaataagggcgacacaaaaggtattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccaggatgcctggcagttccctactctcgccgctgcgctcggtcgttcggctgcgggacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaa

SEQ ID NO: 878 - DNA, 6915 bp, Artificial Sequence
  Description of Artificial Sequence: Synthetic polynucleotide
gaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatgggttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcattgatctcgtccatttccagcacgatgtcatacggtacttttgcttcagccagcaatacgttcatatgtccaggcaaacgccccgcgaccgggtggataccgaaacgcacattaataccacgagcgcgcaatttctcagtaatttcagcgacaggatattgcgcctgcgcgactgccatgccgtaccccggagtaatgatcactgaatgggagtttttcagcagttccgctgtctcttctgcggtgatttcgcggtgctcacccacttcctgatcatcgccagtagaagagccgtcggtgccgaaaccacccgcaataacgctgataaaggaacggttcatcgcctcacacataatgtaagaaaggatagcccccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaattgcggtcattatcagcaatgccagcacttgcaggccgacgctgtccgtgcgaacaaatacaatcagcagcaggaaggaaacgaccagagccgccaggttcattttgtgacggtttggcagcatcaatggtttagacgaaatcttgccacacagtttgccgaacgccaccaccgaacccgtgaacgttaccgccccgatgaagataccgaggaacacttccgtcaggtgaatattgaccagaatcggtgccattcccgcgtcatgatgcagatagctgttaaagccaaccagcactgccgccagacccacgaagctatgcaggatcgccaccagttctggcatttcggtcatttcaactttcttcgccagacggataccaattgccccaccaatgaccatcgccagcaagatccagccaacattacccgtatccggtccaaaaatggttgcgattaacgcaatcgccatcccggcgataccgaagttgttaccctggcgagacgtttcatgtttcgaaagaccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaaaacggtgaagtgcccaaggaattctttcggcgcaacgcttgccatccagccaaaaagaatgattgccagcgccatcaacgcgtatttacgccacggtgagcaggtacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatattgccgtctttctctttgcacaacagtttcagcagattaacgaggtttgtgccgtaaagctgtgaggattgcgtcggcagacggcccggaagatcggtataaccaatcactttgacaccattttccgtagtgaagatttcacccggcacggtgtattcacagttgccgccgttttgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcgccgctgccagcttcctctttaaaatccagctcgaggaattccgcgcccatactttgaacttgttctttcacttccgggcgggtgtcgaatgcacgcacaatcgcgccgagactgtttgctgcgccaatggcggccagacctgcaacacccgcaccaatcaccatcacttttgccggtggcactttcccggccgcagtaatttgcccggtaaagaagcgcccaaattcatgtgccgcttcaacaatggcgcgataaccggcgatgttcgccatcgagcttagtgcgtccagcgattgtgcgcgtgagatacgcggcacagagtccatcgccatcacggtcacgttacgttccgcaagtttttgcattaattccggattctgcgcaggccagataaaactcaccagcgttgtcccaggattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattgccatggtaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatattcacaggtgtatcgctcaatactgaccatttaaatcatacctgacctccatagcagaaagtcaaaagcctccgaccggaggcttttgacttgagggggatcagcttctattatttctcttgcaggcccagtttcttttccaggtagtgaatgttcgtaccgccgtgctggaaattctcgtcgttcataatgcggatctgcaaatccacattggtcttaatgccatcaatgatcagctcttgcagcgcgtttttcatgcgggcgatcgcatgtttttcctcctgccccgcgcttataagcgaataaaggaagatggccgccccgcagggcagcaggtctgtgaaacagtatagagattcatcggcacaaaggctttgctttttgtcatttattcaaaccggcgcctcgaaccggctccgggcattgccctggccggcactttgcatggggagatgcggatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacg

SEQ ID NO: 879 - DNA, 10578 bp, Artificial Sequence
  Description of Artificial Sequence: Synthetic polynucleotide
gaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatgggttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcattgatctcgtccatttccagcacgatgtcatacggtacttttgcttcagccagcaatacgttcatatgtccaggcaaacgccccgcgaccgggtggataccgaaacgcacattaataccacgagcgcgcaatttctcagtaatttcagcgacaggatattgcgcctgcgcgactgccatgccgtaccccggagtaatgatcactgaatgggagtttttcagcagttccgctgtctcttctgcggtgatttcgcggtgctcacccacttcctgatcatcgccagtagaagagccgtcggtgccgaaaccacccgcaataacgctgataaaggaacggttcatcgcctcacacataatgtaagaaaggatagcccccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaattgcggtcattatcagcaatgccagcacttgcaggccgacgctgtccgtgcgaacaaatacaatcagcagcaggaaggaaacgaccagagccgccaggttcattttgtgacggtttggcagcatcaatggtttagacgaaatcttgccacacagtttgccgaacgccaccaccgaacccgtgaacgttaccgccccgatgaagataccgaggaacacttccgtcaggtgaatattgaccagaatcggtgccattcccgcgtcatgatgcagatagctgttaaagccaaccagcactgccgccagacccacgaagctatgcaggatcgccaccagttctggcatttcggtcatttcaactttcttcgccagacggataccaattgccccaccaatgaccatcgccagcaagatccagccaacattacccgtatccggtccaaaaatggttgcgattaacgcaatcgccatcccggcgataccgaagttgttaccctggcgagacgtttcatgtttcgaaagaccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaaaacggtgaagtgcccaaggaattctttcggcgcaacgcttgccatccagccaaaaagaatgattgccagcgccatcaacgcgtatttacgccacggtgagcaggtacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatattgccgtctttctctttgcacaacagtttcagcagattaacgaggtttgtgccgtaaagctgtgaggattgcgtcggcagacggcccggaagatcggtataaccaatcactttgacaccattttccgtagtgaagatttcacccggcacggtgtattcacagttgccgccgttttgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcgccgctgccagcttcctctttaaaatccagctcgaggaattccgcgcccatactttgaacttgttctttcacttccgggcgggtgtcgaatgcacgcacaatcgcgccgagactgtttgctgcgccaatggcggccagacctgcaacacccgcaccaatcaccatcacttttgccggtggcactttcccggccgcagtaatttgcccggtaaagaagcgcccaaattcatgtgccgcttcaacaatggcgcgataaccggcgatgttcgccatcgagcttagtgcgtccagcgattgtgcgcgtgagatacgcggcacagagtccatcgccatcacggtcacgttacgttccgcaagtttttgcattaattccggattctgcgcaggccagataaaactcaccagcgttgtcccaggattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattgccatggtaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatattcacaggtgtatcgctcaatactgaccatttaaatcatacctgacctccatagcagaaagtcaaaagcctccgaccggaggcttttgacttgagggggatcagcttctattatttctcttgcaggcccagtttcttttccaggtagtgaatgttcgtaccgccgtgctggaaattctcgtcgttcataatgcggatctgcaaatccacattggtcttaatgccatcaatgatcagctcttgcagcgcgtttttcatgcgggcgatcgcgacatcacgattttcgccatagcagatcagtttaccaatcatgctgtcatagtacggcggcacggtgtaaccggcgtagatgtgagactcccaacgaacgccaaaaccacctggcgcgtgaaaacgcgtgatcttaccagggctcggcagaaaggtattcgggtcctccgcattgatacggcactcgaccgcgtgaccacgaacgtgcacctcttcttgcttgatcgacagcggctgaccagccgcaatgcgcagttgctctttgatcagatcaacgccagtaatcatctcggtcaccgggtgctcaacctggatgcgggtattcatttcaatgaagtaaaactcaccattttcgaacaggaactcaaacgtacccgcaccacggtaaccaatgtccacacacgctttcgcacagcgctcaccgatgtagcgacgcagttccggcgtaatacccggagccggtgcctcttccaccaccttctgatgacggcgttgcatggagcaatcacgttctgccaagtagatcgcattgccctgaccatccgccagaacttggatttcaacgtggcgcggattctccagatacttctccatatacaccatatcgttagagaacgccgctttggcttccgcacgggtcatgctgatgctttgcgccagttccgcatcaccacggacgacacgcataccacggccaccgccaccaccagaggctttgataatgaccgggtagccaatacgtttagcgatggcacggttcttgtccatatcgtcacccagcggaccatcgctgcccggaacacacggcacaccggcctttttcatcgctgcaatggcgctcactttgtcgcccatcaggcgaatcgtctccgccttagggccaatgaagatgaaaccgctacgctccacttgttcagcaaagttagcgttctcgctcaggaaaccgtagcccggatgaatcgccactgcaccggtgatctctgccgcagagatgatggccgggatgttcagatagcttttcacgctcggtgccggaccgatgcaaaccgtttcgtcggccagcagaacatgcttcaggtcgcggtctgcgctggaatgcacggcaacagtcttaatgcccagctctttacacgcgcgcaagatacgcagcgcgatttcaccgcggtttgcaatcacgatcttgtccaacatgttcgcctcgttactcgatcacaaccagcggttcatcgaactcaacaggctggccggattccaccaggatcgctttaacagtaccgctcttatccgcttcaatctggttcatcattttcattgcctcaacgatacacagcgtgtcgccgacattgaccttctggccgacttcgatgaaggcttttgcgtccggcgacggcgtgcgatagaaggtgcccaccatcgggctacgcacgatatgacccgaaatctcggccgctgccggtgcctccatgcttggaacggtcgccggtgcagcggcgttgctctgtgccggctgttgcatcatcggagcggcgtatgcttgctgcataaccggaaagctcgctgccggtgccgcacgggaaatacggacgctctcttcaccttcgctgatctccagctcgctgatgccgctttcttcaaccagttcaatcagtttcttgatcttacgaatgtccatggtttttcctccttcgcctgtggtatgaaatttcacacgcattatatacaaaaaaagcgattcagaccccgttggcaagccgcgtggttaactccacgtgctattatgcctccggctcttggtccgggaccggcggaaccacgacaccctcacgcggtgcttcaggattcggagccggcagattcatcaatttcgccagaatgctcgccagtttcagacgcatttctggacggcgaacgatcatgtcgatggcacctttctcaatcaggaactcgctgcgctggaaaccaggcggcaacttttcgcgaaccgtctgttcaataacacgcggaccagcaaaaccaatcagagccttcggctctgcgatgttcaaatcacccagcatcgcaaagctggcgctgacaccgcccatcgtagggtcggtcaggacggaaatgtacggcaggccgcgttcttgcatcttcgccagggctgccgaggtttttgccatctgcatcaggctcatcagggcctcttgcatacgcgcaccaccgctcgcgctgaaacaaatcagaggacagttatcctccagcgcctgctccacggcacgcacaaagcgtgcgcccaccacggaacccatgctgccacccataaacgcaaactcgaacgccgcagcaacaaccggcataccatacagggtgcctttcataacaaccagtgcgtccttctcaccggtttctttttgtgcagatgccaaacgatccttatacttcttggaatcacggaatttcagaacatctttcggttccagttcgctacccagctcgaccaggctgccctcatccagcaggctatgcagacgattacgagcggtcatacgcatgtgatggtcgcatttcgggcacacttccaggttacgctccagctccgcacgatacaaaacctgaccgcagctatcgcatttggtccagacgccttcagggatgctcgccttgcgggtcggggtgatattggacttaatgcgttcaatccagctcatgattttcctcctttactacgcgtagccatagctcatcaagcgctgatagcgacggtttttcagatcctccgtgctcagcacgtccagatccgccaggtccgccagcagctgggccttcaggctggctgccatcgcctccggattacggtgagcaccgcccagcggttccgggatgatagaatcaatcaacttcagttctttcagacgcggtgcgatgatacccatcgcttccgctgccaatggtgctttatccgcgctcttccacagaatggaagcgcaaccttccgggctaatgacgctgtacgtgctgtattgcagcatgttgaccttatcaccgacaccgatcgccaacgcaccaccgctaccgccctcgccaatcacggtgcaaacgaccggcacacccagacgagacatctcacgcaggttacgtgcgatggcctcgctctgaccacgctcttccgcaccaacgcctgggtacgcacccggcgtatcaatgaacgtgataatcggcatcttaaagcgttcggccatttgcatcagacgcagggccttgcggtagccctccggtgccggcataccaaagttacgacgaatcttttctttcgtctcgcggcctttttgatggccgataatcatcaccggacggccatccaaacgagcaataccgccgacaattgctttatcgtccgcataggcgcggtcgcctgccagttcgtcgaactcgtcaaacgccaggcgcacgtagtccagggtatatgggcgttgtgggtggcgagccaactgggcaatctgccatgcgcccaaatcagcaaagattttgcgagtcagttcaacagacttctcacgcaaacggtggacctcttcgtcgatgttaatgtccagtttctcatcttgacggctaaccgcggtcaggctgtcaatcttcgcttccagttctgcaatcggctgctcgaagtccaggaagttcagggacatgtttttcctcctgccccgcgcttataagcgaataaaggaagatggccgccccgcagggcagcaggtctgtgaaacagtatagagattcatcggcacaaaggctttgctttttgtcatttattcaaaccggcgcctcgaaccggctccgggcattgccctggccggcactttgcatggggagatgcggatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacg

SEQ ID NO: 880 - DNA, 9047 bp, Artificial Sequence
  Description of Artificial Sequence: Synthetic polynucleotide
gaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatttaaaacaggcggtttaaaccgtttaacgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcgcgtgccagatgtttaaactgggcgcggcccacttcatatggcactttcattgcggtcagctgctgttcggttttgcccacagagctgatttccgggatggtgtaaataccggtagggatatcttcaatcagatgtgcggtggcttcgccttttaccagcgcctgcgcggcaatgcgcccctggtcataggccgccgacgccaggctcggataaccaatcacgtcgcccaccgcgtaaacgtgtggctgtgcggtctgatacatgctgttgaccttcagctgtccgcggctgtcagtttctagcccaatgttctgtaacgccagcgaatcggtattaccggtgcgaccgttggcatagagcaggcagtcagctttcagttttttacccgacttcagatgcatgatcacaccatcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccatagataagtacatggcgcggttcgtggtgcatgctgagaattgagtcgctgtcgtaaatgcgtggatgggtgaaatcaacatctgttggatgatatggacgagagccgcaggcaataacaaatttttcagcggttagtgtttcaacgctgccgtccgggcaatccagcgccaacgtatgctcgtcaacaaagcgagcgtttccctgcaatatttcacagtgattacgttcgtaaaatccctgacgcatgcgcgtttgttgattaatcacgttatcggcatggttaaggatatcggcaaaagaagagcggagcagtcgggaatggtcgctgtaaagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccattgcagcgccttcgccgccggggccggaacctattactatggcatcgtaatcgtaggaatgtggggccatggtaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatattcacaggtgtatcgctcaatactgaccatttaaatcatacctgacctccatagcagaaagtcaaaagcctccgaccggaggcttttgacttgagggggatcagcttctattatttctcttgcaggcccagtttcttttccaggtagtgaatgttcgtaccgccgtgctggaaattctcgtcgttcataatgcggatctgcaaatccacattggtcttaatgccatcaatgatcagctcttgcagcgcgtttttcatgcgggcgatcgcgacatcacgattttcgccatagcagatcagtttaccaatcatgctgtcatagtacggcggcacggtgtaaccggcgtagatgtgagactcccaacgaacgccaaaaccacctggcgcgtgaaaacgcgtgatcttaccagggctcggcagaaaggtattcgggtcctccgcattgatacggcactcgaccgcgtgaccacgaacgtgcacctcttcttgcttgatcgacagcggctgaccagccgcaatgcgcagttgctctttgatcagatcaacgccagtaatcatctcggtcaccgggtgctcaacctggatgcgggtattcatttcaatgaagtaaaactcaccattttcgaacaggaactcaaacgtacccgcaccacggtaaccaatgtccacacacgctttcgcacagcgctcaccgatgtagcgacgcagttccggcgtaatacccggagccggtgcctcttccaccaccttctgatgacggcgttgcatggagcaatcacgttctgccaagtagatcgcattgccctgaccatccgccagaacttggatttcaacgtggcgcggattctccagatacttctccatatacaccatatcgttagagaacgccgctttggcttccgcacgggtcatgctgatgctttgcgccagttccgcatcaccacggacgacacgcataccacggccaccgccaccaccagaggctttgataatgaccgggtagccaatacgtttagcgatggcacggttcttgtccatatcgtcacccagcggaccatcgctgcccggaacacacggcacaccggcctttttcatcgctgcaatggcgctcactttgtcgcccatcaggcgaatcgtctccgccttagggccaatgaagatgaaaccgctacgctccacttgttcagcaaagttagcgttctcgctcaggaaaccgtagcccggatgaatcgccactgcaccggtgatctctgccgcagagatgatggccgggatgttcagatagcttttcacgctcggtgccggaccgatgcaaaccgtttcgtcggccagcagaacatgcttcaggtcgcggtctgcgctggaatgcacggcaacagtcttaatgcccagctctttacacgcgcgcaagatacgcagcgcgatttcaccgcggtttgcaatcacgatcttgtccaacatgttcgcctcgttactcgatcacaaccagcggttcatcgaactcaacaggctggccggattccaccaggatcgctttaacagtaccgctcttatccgcttcaatctggttcatcattttcattgcctcaacgatacacagcgtgtcgccgacattgaccttctggccgacttcgatgaaggcttttgcgtccggcgacggcgtgcgatagaaggtgcccaccatcgggctacgcacgatatgacccgaaatctcggccgctgccggtgcctccatgcttggaacggtcgccggtgcagcggcgttgctctgtgccggctgttgcatcatcggagcggcgtatgcttgctgcataaccggaaagctcgctgccggtgccgcacgggaaatacggacgctctcttcaccttcgctgatctccagctcgctgatgccgctttcttcaaccagttcaatcagtttcttgatcttacgaatgtccatggtttttcctccttcgcctgtggtatgaaatttcacacgcattatatacaaaaaaagcgattcagaccccgttggcaagccgcgtggttaactccacgtgctattatgcctccggctcttggtccgggaccggcggaaccacgacaccctcacgcggtgcttcaggattcggagccggcagattcatcaatttcgccagaatgctcgccagtttcagacgcatttctggacggcgaacgatcatgtcgatggcacctttctcaatcaggaactcgctgcgctggaaaccaggcggcaacttttcgcgaaccgtctgttcaataacacgcggaccagcaaaaccaatcagagccttcggctctgcgatgttcaaatcacccagcatcgcaaagctggcgctgacaccgcccatcgtagggtcggtcaggacggaaatgtacggcaggccgcgttcttgcatcttcgccagggctgccgaggtttttgccatctgcatcaggctcatcagggcctcttgcatacgcgcaccaccgctcgcgctgaaacaaatcagaggacagttatcctccagcgcctgctccacggcacgcacaaagcgtgcgcccaccacggaacccatgctgccacccataaacgcaaactcgaacgccgcagcaacaaccggcataccatacagggtgcctttcataacaaccagtgcgtccttctcaccggtttctttttgtgcagatgccaaacgatccttatacttcttggaatcacggaatttcagaacatctttcggttccagttcgctacccagctcgaccaggctgccctcatccagcaggctatgcagacgattacgagcggtcatacgcatgtgatggtcgcatttcgggcacacttccaggttacgctccagctccgcacgatacaaaacctgaccgcagctatcgcatttggtccagacgccttcagggatgctcgccttgcgggtcggggtgatattggacttaatgcgttcaatccagctcatgattttcctcctttactacgcgtagccatagctcatcaagcgctgatagcgacggtttttcagatcctccgtgctcagcacgtccagatccgccaggtccgccagcagctgggccttcaggctggctgccatcgcctccggattacggtgagcaccgcccagcggttccgggatgatagaatcaatcaacttcagttctttcagacgcggtgcgatgatacccatcgcttccgctgccaatggtgctttatccgcgctcttccacagaatggaagcgcaaccttccgggctaatgacgctgtacgtgctgtattgcagcatgttgaccttatcaccgacaccgatcgccaacgcaccaccgctaccgccctcgccaatcacggtgcaaacgaccggcacacccagacgagacatctcacgcaggttacgtgcgatggcctcgctctgaccacgctcttccgcaccaacgcctgggtacgcacccggcgtatcaatgaacgtgataatcggcatcttaaagcgttcggccatttgcatcagacgcagggccttgcggtagccctccggtgccggcataccaaagttacgacgaatcttttctttcgtctcgcggcctttttgatggccgataatcatcaccggacggccatccaaacgagcaataccgccgacaattgctttatcgtccgcataggcgcggtcgcctgccagttcgtcgaactcgtcaaacgccaggcgcacgtagtccagggtatatgggcgttgtgggtggcgagccaactgggcaatctgccatgcgcccaaatcagcaaagattttgcgagtcagttcaacagacttctcacgcaaacggtggacctcttcgtcgatgttaatgtccagtttctcatcttgacggctaaccgcggtcaggctgtcaatcttcgcttccagttctgcaatcggctgctcgaagtccaggaagttcagggacatgtttttcctcctgccccgcgcttataagcgaataaaggaagatggccgccccgcagggcagcaggtctgtgaaacagtatagagattcatcggcacaaaggctttgctttttgtcatttattcaaaccggcgcctcgaaccggctccgggcattgccctggccggcactttgcatggggagatgcggatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacg

SEQ ID NO: 881 - DNA, 8995 bp, Artificial Sequence
  Description of Artificial Sequence: Synthetic polynucleotide
gaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatttaaaacaggcggtttaaaccgtttaacgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcgcgtgccagatgtttaaactgggcgcggcccacttcatatggcactttcattgcggtcagctgctgttcggttttgcccacagagctgatttccgggatggtgtaaataccggtagggatatcttcaatcagatgtgcggtggcttcgccttttaccagcgcctgcgcggcaatgcgcccctggtcataggccgccgacgccaggctcggataaccaatcacgtcgcccaccgcgtaaacgtgtggctgtgcggtctgatacatgctgttgaccttcagctgtccgcggctgtcagtttctagcccaatgttctgtaacgccagcgaatcggtattaccggtgcgaccgttggcatagagcaggcagtcagctttcagttttttacccgacttcagatgcatgatcacaccatcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccatagataagtacatggcgcggttcgtggtgcatgctgagaattgagtcgctgtcgtaaatgcgtggatgggtgaaatcaacatctgttggatgatatggacgagagccgcaggcaataacaaatttttcagcggttagtgtttcaacgctgccgtccgggcaatccagcgccaacgtatgctcgtcaacaaagcgagcgtttccctgcaatatttcacagtgattacgttcgtaaaatccctgacgcatgcgcgtttgttgattaatcacgttatcggcatggttaaggatatcggcaaaagaagagcggagcagtcgggaatggtcgctgtaaagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccattgcagcgccttcgccgccggggccggaacctattactatggcatcgtaatcgtaggaatgtggggccatggtagggcttacctgttcttgaatagttctttcaaactatgagaatattatatcaagaattgtaggattaagcaactgaaatttttaagtagttaagatctataacttcgtataatgtatgctatacgaagttatgtttaaatcatacctgacctccatagcagaaagtcaaaagcctccgaccggaggcttttgacttgagggggatcagcttctattatttctcttgcaggcccagtttcttttccaggtagtgaatgttcgtaccgccgtgctggaaattctcgtcgttcataatgcggatctgcaaatccacattggtcttaatgccatcaatgatcagctcttgcagcgcgtttttcatgcgggcgatcgcgacatcacgattttcgccatagcagatcagtttaccaatcatgctgtcatagtacggcggcacggtgtaaccggcgtagatgtgagactcccaacgaacgccaaaaccacctggcgcgtgaaaacgcgtgatcttaccagggctcggcagaaaggtattcgggtcctccgcattgatacggcactcgaccgcgtgaccacgaacgtgcacctcttcttgcttgatcgacagcggctgaccagccgcaatgcgcagttgctctttgatcagatcaacgccagtaatcatctcggtcaccgggtgctcaacctggatgcgggtattcatttcaatgaagtaaaactcaccattttcgaacaggaactcaaacgtacccgcaccacggtaaccaatgtccacacacgctttcgcacagcgctcaccgatgtagcgacgcagttccggcgtaatacccggagccggtgcctcttccaccaccttctgatgacggcgttgcatggagcaatcacgttctgccaagtagatcgcattgccctgaccatccgccagaacttggatttcaacgtggcgcggattctccagatacttctccatatacaccatatcgttagagaacgccgctttggcttccgcacgggtcatgctgatgctttgcgccagttccgcatcaccacggacgacacgcataccacggccaccgccaccaccagaggctttgataatgaccgggtagccaatacgtttagcgatggcacggttcttgtccatatcgtcacccagcggaccatcgctgcccggaacacacggcacaccggcctttttcatcgctgcaatggcgctcactttgtcgcccatcaggcgaatcgtctccgccttagggccaatgaagatgaaaccgctacgctccacttgttcagcaaagttagcgttctcgctcaggaaaccgtagcccggatgaatcgccactgcaccggtgatctctgccgcagagatgatggccgggatgttcagatagcttttcacgctcggtgccggaccgatgcaaaccgtttcgtcggccagcagaacatgcttcaggtcgcggtctgcgctggaatgcacggcaacagtcttaatgcccagctctttacacgcgcgcaagatacgcagcgcgatttcaccgcggtttgcaatcacgatcttgtccaacatgttcgcctcgttactcgatcacaaccagcggttcatcgaactcaacaggctggccggattccaccaggatcgctttaacagtaccgctcttatccgcttcaatctggttcatcattttcattgcctcaacgatacacagcgtgtcgccgacattgaccttctggccgacttcgatgaaggcttttgcgtccggcgacggcgtgcgatagaaggtgcccaccatcgggctacgcacgatatgacccgaaatctcggccgctgccggtgcctccatgcttggaacggtcgccggtgcagcggcgttgctctgtgccggctgttgcatcatcggagcggcgtatgcttgctgcataaccggaaagctcgctgccggtgccgcacgggaaatacggacgctctcttcaccttcgctgatctccagctcgctgatgccgctttcttcaaccagttcaatcagtttcttgatcttacgaatgtccatggtttttcctccttcgcctgtggtatgaaatttcacacgcattatatacaaaaaaagcgattcagaccccgttggcaagccgcgtggttaactccacgtgctattatgcctccggctcttggtccgggaccggcggaaccacgacaccctcacgcggtgcttcaggattcggagccggcagattcatcaatttcgccagaatgctcgccagtttcagacgcatttctggacggcgaacgatcatgtcgatggcacctttctcaatcaggaactcgctgcgctggaaaccaggcggcaacttttcgcgaaccgtctgttcaataacacgcggaccagcaaaaccaatcagagccttcggctctgcgatgttcaaatcacccagcatcgcaaagctggcgctgacaccgcccatcgtagggtcggtcaggacggaaatgtacggcaggccgcgttcttgcatcttcgccagggctgccgaggtttttgccatctgcatcaggctcatcagggcctcttgcatacgcgcaccaccgctcgcgctgaaacaaatcagaggacagttatcctccagcgcctgctccacggcacgcacaaagcgtgcgcccaccacggaacccatgctgccacccataaacgcaaactcgaacgccgcagcaacaaccggcataccatacagggtgcctttcataacaaccagtgcgtccttctcaccggtttctttttgtgcagatgccaaacgatccttatacttcttggaatcacggaatttcagaacatctttcggttccagttcgctacccagctcgaccaggctgccctcatccagcaggctatgcagacgattacgagcggtcatacgcatgtgatggtcgcatttcgggcacacttccaggttacgctccagctccgcacgatacaaaacctgaccgcagctatcgcatttggtccagacgccttcagggatgctcgccttgcgggtcggggtgatattggacttaatgcgttcaatccagctcatgattttcctcctttactacgcgtagccatagctcatcaagcgctgatagcgacggtttttcagatcctccgtgctcagcacgtccagatccgccaggtccgccagcagctgggccttcaggctggctgccatcgcctccggattacggtgagcaccgcccagcggttccgggatgatagaatcaatcaacttcagttctttcagacgcggtgcgatgatacccatcgcttccgctgccaatggtgctttatccgcgctcttccacagaatggaagcgcaaccttccgggctaatgacgctgtacgtgctgtattgcagcatgttgaccttatcaccgacaccgatcgccaacgcaccaccgctaccgccctcgccaatcacggtgcaaacgaccggcacacccagacgagacatctcacgcaggttacgtgcgatggcctcgctctgaccacgctcttccgcaccaacgcctgggtacgcacccggcgtatcaatgaacgtgataatcggcatcttaaagcgttcggccatttgcatcagacgcagggccttgcggtagccctccggtgccggcataccaaagttacgacgaatcttttctttcgtctcgcggcctttttgatggccgataatcatcaccggacggccatccaaacgagcaataccgccgacaattgctttatcgtccgcataggcgcggtcgcctgccagttcgtcgaactcgtcaaacgccaggcgcacgtagtccagggtatatgggcgttgtgggtggcgagccaactgggcaatctgccatgcgcccaaatcagcaaagattttgcgagtcagttcaacagacttctcacgcaaacggtggacctcttcgtcgatgttaatgtccagtttctcatcttgacggctaaccgcggtcaggctgtcaatcttcgcttccagttctgcaatcggctgctcgaagtccaggaagttcagggacatgtttttcctcctgccccgcgcttataagcgaataaaggaagatggccgccccgcagggcagcaggtctgtgaaacagtatagagattcatcggcacaaaggctttgctttttgtcatttattcaaaccggcgcctcgaaccggctccgggcattgccctggccggcactttgcatggggagatgcggatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacg

SEQ ID NO: 882 - DNA, 10319 bp, Artificial Sequence
  Description of Artificial Sequence: Synthetic polynucleotide
ccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcgagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggtacttggatcctcattagtacagcagacgggcgcgaatggtacccggaatagctttcattgcctgcagcgctttttcggcaacgtcttcgtcggcttcaatatcaataaccacataacccatctgggcggaagtttgcagatattgcgcggcgatgttgacgccctgctcggcgaagattttgttcagcgcagttagcacgcccggacggttttcgtggatgtgcatcagacgacgcccaccgtgcagtggcagcgagacttccgggaagttcaccgcagagagcgttgagccattgtcagaatacttgatcaatttacccgcaacttccaggccgatattctcctgcgcttcctgagtcgaaccgccaatgtgtggcgtcagaaggacgttgtcgaattcacacagcggagaggtaaatggatcgctattggtcgccggttccgtcgggaatacgtcgattgccgcccccgccagatgtttgctcgccagcgcatcacacagcgccggaatatccaccacagtaccgcgcgaagcattaatcagcagcgagccgggcttcattagtgaaatttctttcgcgcccatcatatttttggtggacggattctctggtacatgcagactcaccacatcgctcatattcagcaggtcagaaagatgctgtacctgagtggcgttgcccagcggcagtttattttcaatatcataaaagtaaacatacattcccagcgattcagccagaatgcccaattgcgtaccaatatgaccgtagccgatgatacccagctttttgccgcgcgcttcaaaagaacccgccgccagtttgttccacacgccacggtgcgctttagcattggcttccggcacgccgcgcaatagcagcagcagttcgccaatcaccagctccgcaacagagcgcgtatttgagaacggtgcgttaaataccgggatcccgcgctttgccgccgcatccagatcaacctggtttgttccgatacagaaacagccaatagcgaccagtttttctgcggcgttgatcacgtcttcagtcagatgggtacgggatcgcaggccgatgaagtgggcatcgcggatggattcttttaattgttcatcatccagcgcgcctttgtgaaattcgatgttggtgtaaccagctgcacgaaggctttccagcgccttttggtgcacgccttctaccagcagaaacttaatcttgtctttctccagcgatacctttgccatggtaattctccacgcttataagcgaataaaggaagatggccgccccgcagggcagcaggtctgtgaaacagtatagagattcatcggcacaaaggctttgctttttgtcatttattcaaacctgtacgaaagggtgtatcgctcaatactgaccatttaaatcatacctgacccatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgg

SEQ ID NO: 883 - DNA, 5543 bp, Artificial Sequence
  Description of Artificial Sequence: Synthetic polynucleotide
gtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatgggatctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaattactgcagctggtaccatatgggaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagcgcgaattgatctg

SEQ ID NO: 884 - DNA, 6620 bp, Artificial Sequence
  Description of Artificial Sequence: Synthetic polynucleotide
cgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgcggaagagccgatgcttgacgcggaagagccgatgccagtccagttacgctggagtctgaggctcgtcctgaatgatatcaagcttgattcgtctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgacgaattctctagatatcgctcaatactgaccatttaaatcatacctgacc

SEQ ID NO: 885 - DNA, 10944 bp, Artificial Sequence
  Description of Artificial Sequence: Synthetic polynucleotide
cgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgcggaagagccgatgccagtccagttacgctggagtctgaggctcgtcctgaatgatatcaagcttgattcgtctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggccggtacgggtcgtttggctggtaaaattgcattgatcaccggtggtgctggtaacattggttccgagctgacccgccgttttctggccgagggtgcgacggttattatcagcggccgtaaccgtgcgaagctgaccgcgctggccgagcgcatgcaagccgaggccggcgtgccggccaagcgcattgatttggaggtgatggatggttccgaccctgtggctgtccgtgccggtatcgaggcaatcgtcgctcgccacggtcagattgacattctggttaacaacgcgggctccgccggtgcccaacgtcgcttggcggaaattccgctgacggaggcagaattgggtccgggtgcggaggagactttgcacgcttcgatcgcgaatctgttgggcatgggttggcacctgatgcgtattgcggctccgcacatgccagttggctccgcagttatcaacgtttcgactattttctcgcgcgcagagtactatggtcgcattccgtacgttaccccgaaggcagcgctgaacgctttgtcccagctggctgcccgcgagctgggcgctcgtggcatccgcgttaacactattttcccaggtcctattgagtccgaccgcatccgtaccgtgtttcaacgtatggatcaactgaagggtcgcccggagggcgacaccgcccatcactttttgaacaccatgcgcctgtgccgcgcaaacgaccaaggcgctttggaacgccgctttccgtccgttggcgatgttgctgatgcggctgtgtttctggcttctgctgagagcgcggcactgtcgggtgagacgattgaggtcacccacggtatggaactgccggcgtgtagcgaaacctccttgttggcgcgtaccgatctgcgtaccatcgacgcgagcggtcgcactaccctgatttgcgctggcgatcaaattgaagaagttatggccctgacgggcatgctgcgtacgtgcggtagcgaagtgattatcggcttccgttctgcggctgccctggcgcaatttgagcaggcagtgaatgaatctcgccgtctggcaggtgcggatttcaccccgccgatcgctttgccgttggacccacgtgacccggccaccattgatgcggttttcgattggggcgcaggcgagaatacgggtggcatccatgcggcggtcattctgccggcaacctcccacgaaccggctccgtgcgtgattgaagtcgatgacgaacgcgtcctgaatttcctggccgatgaaattaccggcaccatcgttattgcgagccgtttggcgcgctattggcaatcccaacgcctgaccccgggtgcccgtgcccgcggtccgcgtgttatctttctgagcaacggtgccgatcaaaatggtaatgtttacggtcgtattcaatctgcggcgatcggtcaattgattcgcgtttggcgtcacgaggcggagttggactatcaacgtgcatccgccgcaggcgatcacgttctgccgccggtttgggcgaaccagattgtccgtttcgctaaccgctccctggaaggtctggagttcgcgtgcgcgtggaccgcacagctgctgcacagccaacgtcatattaacgaaattacgctgaacattccagccaatattagcgcgaccacgggcgcacgttccgccagcgtcggctgggccgagtccttgattggtctgcacctgggcaaggtggctctgattaccggtggttcggcgggcatcggtggtcaaatcggtcgtctgctggccttgtctggcgcgcgtgtgatgctggccgctcgcgatcgccataaattggaacagatgcaagccatgattcaaagcgaattggcggaggttggttataccgatgtggaggaccgtgtgcacatcgctccgggttgcgatgtgagcagcgaggcgcagctggcagatctggtggaacgtacgctgtccgcattcggtaccgtggattatttgattaataacgccggtattgcgggcgtggaggagatggtgatcgacatgccggtggaaggctggcgtcacaccctgtttgccaacctgatttcgaattattcgctgatgcgcaagttggcgccgctgatgaagaagcaaggtagcggttacatcctgaacgtttcttcctattttggcggtgagaaggacgcggcgattccttatccgaaccgcgccgactacgccgtctccaaggctggccaacgcgcgatggcggaagtgttcgctcgtttcctgggtccagagattcagatcaatgctattgccccaggtccggttgaaggcgaccgcctgcgtggtaccggtgagcgtccgggcctgtttgctcgtcgcgcccgtctgatcttggagaataaacgcctgaacgaattgcacgcggctttgattgctgcggcccgcaccgatgagcgctcgatgcacgagttggttgaattgttgctgccgaacgacgtggccgcgttggagcagaacccagcggcccctaccgcgctgcgtgagctggcacgccgcttccgtagcgaaggtgatccggcggcaagctcctcgtccgccttgctgaatcgctccatcgctgccaagctgttggctcgcttgcataacggtggctatgtgctgccggcggatatttttgcaaatctgcctaatccgccggacccgttctttacccgtgcgcaaattgaccgcgaagctcgcaaggtgcgtgatggtattatgggtatgctgtatctgcagcgtatgccaaccgagtttgacgtcgctatggcaaccgtgtactatctggccgatcgtaacgtgagcggcgaaactttccatccgtctggtggtttgcgctacgagcgtaccccgaccggtggcgagctgttcggcctgccatcgccggaacgtctggcggagctggttggtagcacggtgtacctgatcggtgaacacctgaccgagcacctgaacctgctggctcgtgcctatttggagcgctacggtgcccgtcaagtggtgatgattgttgagacggaaaccggtgcggaaaccatgcgtcgtctgttgcatgatcacgtcgaggcaggtcgcctgatgactattgtggcaggtgatcagattgaggcagcgattgaccaagcgatcacgcgctatggccgtccgggtccggtggtgtgcactccattccgtccactgccaaccgttccgctggtcggtcgtaaagactccgattggagcaccgttttgagcgaggcggaatttgcggaactgtgtgagcatcagctgacccaccatttccgtgttgctcgtaagatcgccttgtcggatggcgcgtcgctggcgttggttaccccggaaacgactgcgactagcaccacggagcaatttgctctggcgaacttcatcaagaccaccctgcacgcgttcaccgcgaccatcggtgttgagtcggagcgcaccgcgcaacgtattctgattaaccaggttgatctgacgcgccgcgcccgtgcggaagagccgcgtgacccgcacgagcgtcagcaggaattggaacgcttcattgaagccgttctgctggttaccgctccgctgcctcctgaggcagacacgcgctacgcaggccgtattcaccgcggtcgtgcgattaccgtctaatagaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgacgaattctctagaaagtataggaacttctgaaggggggacagctgtctcaaatgtctcggaatcgctgacgattcccaggtttctccggcaagcatagcgcatggcgtctccatgcgagaatgtcgcgcttgccggataaaaggggagccgctatcggaatggacgcaagccacggccgcagcaggtgcggtcgagggcttccagccagttccagggcagatgtgccggcagaccctcccgctttgggggaggcgcaagccgggtccattcggatagcatctccccatgcaaagtgccggccagggcaatgcccggagccggttcgaggcgccggtttgaataaatgacaaaaagcaaagcctttgtgccgatgaatctctatactgtttcacagacctgctgccctgcggggcggccatcttcctttattcgcttataagcgcggggcaggaggaaaaacatgtccctgaacttcctggacttcgagcagccgattgcagaactggaagcgaagattgacagcctgaccgcggttagccgtcaagatgagaaactggacattaacatcgacgaagaggtccaccgtttgcgtgagaagtctgttgaactgactcgcaaaatctttgctgatttgggcgcatggcagattgcccagttggctcgccacccacaacgcccatataccctggactacgtgcgcctggcgtttgacgagttcgacgaactggcaggcgaccgcgcctatgcggacgataaagcaattgtcggcggtattgctcgtttggatggccgtccggtgatgattatcggccatcaaaaaggccgcgagacgaaagaaaagattcgtcgtaactttggtatgccggcaccggagggctaccgcaaggccctgcgtctgatgcaaatggccgaacgctttaagatgccgattatcacgttcattgatacgccgggtgcgtacccaggcgttggtgcggaagagcgtggtcagagcgaggccatcgcacgtaacctgcgtgagatgtctcgtctgggtgtgccggtcgtttgcaccgtgattggcgagggcggtagcggtggtgcgttggcgatcggtgtcggtgataaggtcaacatgctgcaatacagcacgtacagcgtcattagcccggaaggttgcgcttccattctgtggaagagcgcggataaagcaccattggcagcggaagcgatgggtatcatcgcaccgcgtctgaaagaactgaagttgattgattctatcatcccggaaccgctgggcggtgctcaccgtaatccggaggcgatggcagccagcctgaaggcccagctgctggcggacctggcggatctggacgtgctgagcacggaggatctgaaaaaccgtcgctatcagcgcttgatgagctatggctacgcgtagtaaaggaggaaaatcatgagctggattgaacgcattaagtccaatatcaccccgacccgcaaggcgagcatccctgaaggcgtctggaccaaatgcgatagctgcggtcaggttttgtatcgtgcggagctggagcgtaacctggaagtgtgcccgaaatgcgaccatcacatgcgtatgaccgctcgtaatcgtctgcatagcctgctggatgagggcagcctggtcgagctgggtagcgaactggaaccgaaagatgttctgaaattccgtgattccaagaagtataaggatcgtttggcatctgcacaaaaagaaaccggtgagaaggacgcactggttgttatgaaaggcaccctgtatggtatgccggttgttgctgcggcgttcgagtttgcgtttatgggtggcagcatgggttccgtggtgggcgcacgctttgtgcgtgccgtggagcaggcgctggaggataactgtcctctgatttgtttcagcgcgagcggtggtgcgcgtatgcaagaggccctgatgagcctgatgcagatggcaaaaacctcggcagccctggcgaagatgcaagaacgcggcctgccgtacatttccgtcctgaccgaccctacgatgggcggtgtcagcgccagctttgcgatgctgggtgatttgaacatcgcagagccgaaggctctgattggttttgctggtccgcgtgttattgaacagacggttcgcgaaaagttgccgcctggtttccagcgcagcgagttcctgattgagaaaggtgccatcgacatgatcgttcgccgtccagaaatgcgtctgaaactggcgagcattctggcgaaattgatgaatctgccggctccgaatcctgaagcaccgcgtgagggtgtcgtggttccgccggtcccggaccaagagccggaggcataatagcacgtggagttaaccacgcggcttgccaacggggtctgaatcgctttttttgtatataatgcgtgtgaaatttcataccacaggcgaaggaggaaaaaccatggacattcgtaagatcaagaaactgattgaactggttgaagaaagcggcatcagcgagctggagatcagcgaaggtgaagagagcgtccgtatttcccgtgcggcaccggcagcgagctttccggttatgcagcaagcatacgccgctccgatgatgcaacagccggcacagagcaacgccgctgcaccggcgaccgttccaagcatggaggcaccggcagcggccgagatttcgggtcatatcgtgcgtagcccgatggtgggcaccttctatcgcacgccgtcgccggacgcaaaagccttcatcgaagtcggccagaaggtcaatgtcggcgacacgctgtgtatcgttgaggcaatgaaaatgatgaaccagattgaagcggataagagcggtactgttaaagcgatcctggtggaatccggccagcctgttgagttcgatgaaccgctggttgtgatcgagtaacgaggcgaacatgttggacaagatcgtgattgcaaaccgcggtgaaatcgcgctgcgtatcttgcgcgcgtgtaaagagctgggcattaagactgttgccgtgcattccagcgcagaccgcgacctgaagcatgttctgctggccgacgaaacggtttgcatcggtccggcaccgagcgtgaaaagctatctgaacatcccggccatcatctctgcggcagagatcaccggtgcagtggcgattcatccgggctacggtttcctgagcgagaacgctaactttgctgaacaagtggagcgtagcggtttcatcttcattggccctaaggcggagacgattcgcctgatgggcgacaaagtgagcgccattgcagcgatgaaaaaggccggtgtgccgtgtgttccgggcagcgatggtccgctgggtgacgatatggacaagaaccgtgccatcgctaaacgtattggctacccggtcattatcaaagcctctggtggtggcggtggccgtggtatgcgtgtcgtccgtggtgatgcggaactggcgcaaagcatcagcatgacccgtgcggaagccaaagcggcgttctctaacgatatggtgtatatggagaagtatctggagaatccgcgccacgttgaaatccaagttctggcggatggtcagggcaatgcgatctacttggcagaacgtgattgctccatgcaacgccgtcatcagaaggtggtggaagaggcaccggctccgggtattacgccggaactgcgtcgctacatcggtgagcgctgtgcgaaagcgtgtgtggacattggttaccgtggtgcgggtacgtttgagttcctgttcgaaaatggtgagttttacttcattgaaatgaatacccgcatccaggttgagcacccggtgaccgagatgattactggcgttgatctgatcaaagagcaactgcgcattgcggctggtcagccgctgtcgatcaagcaagaagaggtgcacgttcgtggtcacgcggtcgagtgccgtatcaatgcggaggacccgaatacctttctgccgagccctggtaagatcacgcgttttcacgcgccaggtggttttggcgttcgttgggagtctcacatctacgccggttacaccgtgccgccgtactatgacagcatgattggtaaactgatctgctatggcgaaaatcgtgatgtcgcgatcgcccgcatgaaaaacgcgctgcaagagctgatcattgatggcattaagaccaatgtggatttgcagatccgcattatgaacgacgagaatttccagcacggcggtacgaacattcactacctggaaaagaaactgggcctgcaagagaaataatagggtaccctagcataaccccttggggcctctaaacgggtcttgaggggttttttgaatcccccgggatgtctatcttaaggtagccaaagtttaaatcatacctgacc

SEQ ID NO: 886 - DNA, 1401 bp, Escherichia coli
atgccacattcctacgattacgatgccatagtaataggttccggccccggcggcgaaggcgctgcaatgggcctggttaagcaaggtgcgcgcgtcgcagttatcgagcgttatcaaaatgttggcggcggttgcacccactggggcaccatcccgtcgaaagctctccgtcacgccgtcagccgcattatagaattcaatcaaaacccactttacagcgaccattcccgactgctccgctcttcttttgccgatatccttaaccatgccgataacgtgattaatcaacaaacgcgcatgcgtcagggattttacgaacgtaatcactgtgaaatattgcagggaaacgctcgctttgttgacgagcatacgttggcgctggattgcccggacggcagcgttgaaacactaaccgctgaaaaatttgttattgcctgcggctctcgtccatatcatccaacagatgttgatttcacccatccacgcatttacgacagcgactcaattctcagcatgcaccacgaaccgcgccatgtacttatctatggtgctggagtgatcggctgtgaatatgcgtcgatcttccgcggtatggatgtaaaagtggatctgatcaacacccgcgatcgcctgctggcatttctcgatcaagagatgtcagattctctctcctatcacttctggaacagtggcgtagtgattcgtcacaacgaagagtacgagaagatcgaaggctgtgacgatggtgtgatcatgcatctgaagtcgggtaaaaaactgaaagctgactgcctgctctatgccaacggtcgcaccggtaataccgattcgctggcgttacagaacattgggctagaaactgacagccgcggacagctgaaggtcaacagcatgtatcagaccgcacagccacacgtttacgcggtgggcgacgtgattggttatccgagcctggcgtcggcggcctatgaccaggggcgcattgccgcgcaggcgctggtaaaaggcgaagccaccgcacatctgattgaagatatccctaccggtatttacaccatcccggaaatcagctctgtgggcaaaaccgaacagcagctgaccgcaatgaaagtgccatatgaagtgggccgcgcccagtttaaacatctggcacgcgcacaaatcgtcggcatgaacgtgggcacgctgaaaattttgttccatcgggaaacaaaagagattctgggtattcactgctttggcgagcgcgctgccgaaattattcatatcggtcaggcgattatggaacagaaaggtggcggcaacactattgagtacttcgtcaacaccacctttaactacccgacgatggcggaagcctatcgggtagctgcgttaaacggtttaaaccgcctgttttaa

SEQ ID NO: 887 - DNA, 8995 bp, Artificial Sequence; identical to SEQ ID NO: 881
  Description of Artificial Sequence: Synthetic polynucleotide

SEQ ID NO: 888 - protein, 415 aa, Escherichia coli
MALNIPFRNAYYRFASSYSFLFFISWSLWWSLYAIWLKGHLGLTGTELGTLYSVNQFTSILFMMFYGIVQDKLGLKKPLIWCMSFILVLTGPFMIYVYEPLLQSNFSVGLILGALFFGLGYLAGCGLLDSFTEKMARNFHFEYGTARAWGSFGYAIGAFFAGIFFSISPHINFWLVSLFGAVFMMINMRFKDKDHQCIAADAGGVKKEDFIAVFKDRNFWVFVIFIVGTWSFYNIFDQQLFPVFYAGLFESHDVGTRLYGYLNSFQVVLEALCMAIIPFFVNRVGPKNALLIGVVIMALRILSCALFVNPWIISLVKLLHAIEVPLCVISVFKYSVANFDKRLSSTIFLIGFQIASSLGIVLLSTPTGILFDHAGYQTVFFAISGIVCLMLLFGIFFLSKKREQIVMETPVPSAI

SEQ ID NO: 889 - protein, 307 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELESEK

SEQ ID NO: 890 - protein, 477 aa, Escherichia coli
MTQSRLHAAQNALAKLHERRGNTFYPHFHLAPPAGWMNDPNGLIWFNDRYHAFYQHHPMSEHWGPMHWGHATSDDMIHWQHEPIALAPGDENDKDGCFSGSAVDDNGVLSLIYTGHVWLDGAGNDDAIREVQCLATSRDGIHFEKQGVILTPPEGIMHFRDPKVWREADTWWMVVGAKDPGNTGQILLYRGSSLREWTFDRVLAHADAGESYMWECPDFFSLGDQHYLMFSPQGMNAEGYSYRNRFQSGVIPGMWSPGRLFAQSGHFTELDNGHDFYAPQSFVAKDGRRIVIGWMDMWESPMPSKREGWAGCMTLARELSESNGKLLQRPVHEAESLRQQHQSISPRTISNKYVLQENAQAVEIQLQWALKNSDAEHYGLQLGAGMRLYIDNQSERLVLWRYYPHENLDGYRSIPLPQGDMLALRIFIDTSSVEVFINDGEAVMSSRIYPQPEERELSLYASHGVAVLQHGALWQLG

SEQ ID NO: 891 - DNA, 3847 bp, Artificial Sequence
  Description of Artificial Sequence: Synthetic polynucleotide
tcacctcctaactacttaaaattgctatcattcgttattgttatctagttgtgcaaaacattgacatccctatcagtgatagatataatgagcacatgcccaccggcagctgccggtgggccgtattttggatgataacaggaggcaaaaccatggccctgaacatcccattccgcaacgcatactaccgcttcgcaagcagctacagcttcctgttcttcatttcctggagcttgtggtggtcgctgtatgctatctggctgaaaggtcatctgggcttgacgggtacggaactgggtaccctgtattccgttaatcaatttacgtccatcctgtttatgatgttttacggcatcgtgcaggataagctgggcctgaagaaaccgctgatctggtgtatgagcttcatcctggttctgaccggtccgtttatgatttacgtgtacgaaccgctgctgcagtccaactttagcgtgggcctgatcctgggtgcgttgtttttcggcttgggttacctggccggttgtggtctgctggatagctttacggaaaagatggcgcgtaactttcactttgaatatggtaccgcgcgtgcgtggggttcgttcggctacgctatcggcgcgttcttcgccggcattttcttcagcattagcccgcacatcaatttctggctggttagcctgttcggtgcggtctttatgatgatcaacatgcgttttaaggacaaggatcaccagtgtattgcagcggatgctggtggtgttaagaaagaggactttattgcagttttcaaagatcgcaacttctgggtgttcgtgatcttcattgtcggtacctggtccttttacaatatcttcgatcagcaactgtttccggttttctatgcgggcctgttcgaaagccacgatgttggcacgcgtctgtacggttatctgaatagctttcaagtcgtcctggaagctctgtgtatggcgatcattccgttctttgttaaccgtgtaggcccgaaaaatgcgttgctgattggcgttgtgattatggcactgcgtatcctgagctgcgcactgtttgtgaatccgtggatcattagcctggtgaaactgctgcacgctattgaagtcccgctgtgtgtcatctctgttttcaagtattccgtcgcgaacttcgacaagcgtttgtccagcaccatcttcctgatcggtttccaaattgcaagcagcctgggtattgttctgttgagcacgccgactggtattttgtttgatcacgctggttatcagactgtgttctttgcgatctcgggtatcgtttgcttgatgctgctgttcggtatctttttcctgtctaagaaacgcgagcaaattgttatggaaaccccggttcctagcgcgatctaaggaggtaatacacatgtcagcgaaagtatgggtcctgggcgacgcagtagtagatctgttgccggaaagcgacggtcgtctgctgccgtgtccgggtggtgcaccggctaatgttgcggtgggcatcgcgcgtctgggtggtacctcgggttttatcggtcgcgtgggtgacgaccctttcggtgcgctgatgcagcgcactttgctgaccgagggtgtggatatcacgtatctgaagcaggatgagtggcatcgtacctctaccgtcctggtggacctgaatgaccagggtgaacgtagcttcaccttcatggtgcgcccgagcgccgatttgtttctggaaacgaccgatctgccgtgttggcgtcacggcgagtggctgcacttgtgtagcattgcactgtctgcggaaccgtcgcgcacgagcgccttcaccgcgatgacggcaatccgccatgcaggtggctttgtctccttcgacccgaacattcgtgaggatctgtggcaggacgagcacctgttgcgcctgtgcctgcgtcaagcactgcagttggccgacgttgtaaaactgtccgaagaagagtggcgtctgatctctggtaaaacgcagaatgaccgcgatatttgtgcgctggctaaagagtatgagatcgccatgttgctggtgacgaagggtgccgaaggtgttgttgtgtgctatcgtggtcaggtgcaccattttgcaggcatgtccgtgaattgcgtggattctacgggcgcaggcgatgcgttcgtcgcgggtctgttgaccggtctgagcagcaccggcctgtcgaccgatgaacgtgaaatgcgtcgtatcattgacctggcgcagcgttgcggtgccttggcggttaccgcaaagggtgccatgaccgcattgccgtgccgtcaggagctggaaagcgagaaataaggaggtaatactcatgactcaatcccgcctgcacgcagcacaaaacgcactggcaaagctgcatgagcgtcgtggtaacaccttctacccacacttccacctggcgccacctgcgggttggatgaacgatccgaacggcctgatttggttcaacgaccgttaccatgcgttctatcaacaccaccctatgtccgagcattggggtccgatgcattggggccacgctaccagcgatgacatgatccattggcagcacgagccgattgccctggcaccgggtgatgagaacgacaaggatggttgcttcagcggttctgctgtcgatgataacggtgtcctgtctctgatctacaccggtcatgtctggctggatggcgctggcaatgacgacgcaatccgtgaagttcaatgcctggcgacctcgcgtgacggcattcacttcgagaaacagggcgtcattttgacgccgcctgagggtatcatgcactttcgcgacccaaaagtttggcgtgaagcggacacgtggtggatggtcgtcggcgcgaaagacccgggtaacacgggtcagattctgctgtatcgtggcagcagcctgcgtgagtggaccttcgaccgcgtcctggcccatgctgatgcgggcgagagctatatgtgggaatgcccagacttcttttctctgggcgaccaacattatctgatgttcagcccgcaaggcatgaatgcggagggctacagctaccgtaaccgctttcagagcggcgttatcccgggtatgtggagcccaggtcgcctgtttgctcagtccggtcattttaccgagctggacaatggtcacgatttctatgcaccgcaatcgttcgtggcgaaagatggccgtcgcatcgttattggttggatggatatgtgggaaagcccgatgccgagcaagcgtgagggttgggcgggttgcatgaccctggcccgtgagctgagcgagagcaatggcaaattgctgcaacgcccggtgcacgaggcagaaagcctgcgccagcaacaccaaagcatcagccctcgtaccattagcaacaaatacgttctgcaggaaaatgcgcaggccgttgagattcaactgcaatgggccctgaaaaacagcgacgcggagcattacggcctgcagctgggtgcgggcatgcgtttgtacattgataatcaaagcgagcgtttggttttgtggcgctactacccgcatgagaacctggacggctaccgtagcatcccgctgccgcagggtgacatgctggcgctgcgtattttcattgatactagcagcgtcgaggtattcatcaatgacggcgaagccgtgatgtctagccgtatttacccgcagccggaggaacgcgagctgagcttgtatgccagccacggtgtcgcggtgctgcaacacggtgcactgtggcaactgggttaagcttcagtagcgctgtctggcaacataaacggccccttctgggcaatgccgatcagttaagga

SEQ ID NO: 892 - DNA, 1242 bp, Escherichia coli
gtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaa

SEQ ID NO: 893 - DNA, 1221 bp, Artificial Sequence
  Description of Artificial Sequence: Synthetic polynucleotide
atgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaatcgctgatgcgggcctctctccggaagcttaccagaataacccgcgcgttggcctgattgcaggttccggcggcggctccccgcgtttccaggtgttcggcgctgacgcaatgcgcggcccgcgcggcctgaaagcggttggcccgtatgtggtcaccaaagcgatggcatccggcgtttctgcctgcctcgccaccccgtttaaaattcatggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcaatgggtgcgctgtctactaaatacaacgacaccccggaaaaagcctcccgtacttacgacgctcaccgtgacggtttcgttatcgctggcggcggcggtatggtagtggttgaagagctggaacacgcgctggcgcgtggtgctcacatctatgctgaaatcgttggctacggcgcaacctctgatggtgcagacatggttgctccgtctggcgaaggcgcagtacgctgcatgaagatggcgatgcatggcgttgataccccaatcgattacctgaactcccacggtacttcgactccggttggcgacgtgaaagagctggcagctatccgtgaagtgttcggcgataagagcccggcgatttctgcaaccaaagtcatgaccggtcactctctgggcgctgctggcgtacaggaagctatctactctctgctgatgctggaacacggctttatcgccccgagcatcaacattgaagagctggacgagcaggctgcgggtctgaacatcgtgaccgaaacgaccgatcgcgaactgaccaccgttatgtctaacagcttcggcttcggcggcaccaacgccacgctggtaatgcgcaagctgaaagattaa

SEQ ID NO: 894 - DNA, 2503 bp, Artificial Sequence
  Description of Artificial Sequence: Synthetic polynucleotide
cttacaggcggtggctcgatcttagcgatgtgtgtaaggctgcgcaaatttctctattaaatggctgatcggacttgttcggcgtacaagtgtacgctattgtgcattcgaaacttactctatgtgcgacttacagaggtattgaatgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaatcgctgatgcgggcctctctccggaagcttaccagaataacccgcgcgttggcctgattgcaggttccggcggcggctccccgcgtttccaggtgttcggcgctgacgcaatgcgcggcccgcgcggcctgaaagcggttggcccgtatgtggtcaccaaagcgatggcatccggcgtttctgcctgcctcgccaccccgtttaaaattcatggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcaatgggtgcgctgtctactaaatacaacgacaccccggaaaaagcctcccgtacttacgacgctcaccgtgacggtttcgttatcgctggcggcggcggtatggtagtggttgaagagctggaacacgcgctggcgcgtggtgctcacatctatgctgaaatcgttggctacggcgcaacctctgatggtgcagacatggttgctccgtctggcgaaggcgcagtacgctgcatgaagatggcgatgcatggcgttgataccccaatcgattacctgaactcccacggtacttcgactccggttggcgacgtgaaagagctggcagctatccgtgaagtgttcggcgataagagcccggcgatttctgcaaccaaagtcatgaccggtcactctctgggcgctgctggcgtacaggaagctatctactctctgctgatgctggaacacggctttatcgccccgagcatcaacattgaagagctggacgagcaggctgcgggtctgaacatcgtgaccgaaacgaccgatcgcgaactgaccaccgttatgtctaacagcttcggcttcggcggcaccaacgccacgctggtaatgcgcaagctgaaagattaattcgcagtaggtcggagtagacgcgccagcgtcgcatccgacgttacgcgccaatgcggcctccggcactaacgcatttaaataggcctggcgctagatcagtttaaacataacttcgtatagcatacattatacgaagttattgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataacttcgtatagcatacattatacgaagttatagatctgtcgacgggaacctgatggttccctttttcacatcattgacaatcgccgccagttccaggcaaacttcccgctttgtcgatttccttctgaaaagacgtacgcgttaaatcctgccaacgcaccgtaaccctgaaaccagagagatgagacggggatactcctcgccttgcgctgcattctggagtaatgcatgactgctgtaagccaaaccgaaacacgatcttctgccaatttttcgctcttccgcatcgcttttgcggtttttctcacctacatgaccgtagggttgccgttgccggttatcccgctgtttgttcatcatgaactgggctatggcaataccatggtcggcattgccgtcgggattcagtttctggctacggtgctgacgcgtggttacgccgggcgactggccgatcaatatggtgcaaaacgttcggcgcttcagggaatgttagcttgtggtctggctggcggcgcgttgctg

SEQ ID NO: 895 - DNA, 3651 bp, Artificial Sequence
  Description of Artificial Sequence: Synthetic polynucleotide
atgagcaaagaaggtaatgcggccaaaggccgcctggagggtaaagtggccctgatcaccggtgcagctggcaacctgggtaatgaaattagccgcgcgtttgcccgtgagggtgcgttcgtggttatgaccggccgcacggaagaacgtatctctgcggcccgcgaacagctgattgcggataccggtgtcgccccggaacgtatcgacacggcggtgctggatggcggtaacccggactctattcgtgcagctatggccaaactgcgcaaagaatatggccgtattgatatcctgattaacaatgcaggttcagcaggtccgaaacagccgctgcataatgttccgctgtcgccgcaagaaatggaagcatgcggtgataccgaaacggtgcgcgacgcgatgctgaacatcctgggcgtgacctggaatatggctcgtattgttgcgccgatgatgccggtgggcggtgcaatggttaatatcagcaccatttttagccacacgcgctattacggccgtaccgcgtatgtcgtgccgaaagcggccctgaacgcactgagcaatcagctggcttctgaactgggcccgcgtggtattcgcgttaacaccgtctttccgggtccgatcgaaagtgatcgtattcgcacggtgttcgcagctatggatgaagttcagtcccaaccgaaagacaccacggcgaattactttaccggtcgtatggcactgacgcgtagcgtcaacggcaaagtggatggtaaaccgctgccgaatccgaaagacatcgcgggtacctgtctgttcctggccagtgaagaagcggccggcattgccggtgaagaagttgatgtcacccatggcctgtccgcaaaccgcacgtctgctagtacctatatgacgcgcccgtctatgcgtagtctggatggcgcgggtctgaacatcttcatcgtttcaggtgaaaactgggatgacgccctggtcgcagctcacaccctgatcggctcgggtgcaaaagtgcgcctgggcctggcacgtaacgctgatgttgcacaggctaatgcgcgtctgaaagcgcaaggcattggtgaagaactgaccgttacgcgttttaatcgcgccgaaccggacgcaatggaagatgctctggcggccttcagtggcgacgttgatggtgcgatcaccggcgccattatcctgccggtcaaaccgagcggtcattttacgggctctctgctggcagctgatgacgataccgtgacgaaattcatggataccgaactggtcggtgccattgcagtgtcccgttcactggcacgttactggcacggtcgtgaagatttgcagagcccgccgcgttgcgtttttatgaccaacccgggtgacccgctgggcaattccttcgcgtcagtgctgtcggccggtatcacgcagctgatccgtatttggcgcgatgaagaacgcgttcaagcaggcaacggtagtaccgaacatgcggtctggtccaatcagattgtgcgccacaccaacacggaagatgaaaatacccgttttgcaagcggccatgctacgcgcgtgctgttccgtgaacaacacatcgccgaaattgatctgaaactgccggcaaacatcagtgaagaaaccggttcccgcaaagcaatggtgggctttgctgaaaatattaccggtctgcatctgggcaaagttgcattcatcacgggcggtagtgctggtattggcggtcaggtggcacgtctgctggctctggcaggtgccaaagtgatgatggttgcacgtcgcgaatccgaactggtcgcggcacgtgatcgcatcgtgggtgaactgcaagacattggctttgcgggtgttgaacgtcgcgtcaaatatatggcggacattgatgtcagtgattttgcctccctggacaaagcggtggatgccaccctggaagaattcggccgtatcgactacctgattaacaatgcgggcgttgcaggtgctgaagacatggtcatcgatatggaaccggaagcctggcgcttcaccctggatgcaaacctgattagcaattatcatctgatgcagcgtgttgtcccgctgatgaaagaacaaggctctggttatgtcctgaacgtgagctcttactttggcggtgaaaaattcctggcggttgcctatccgaatcgcgccgattacggtctgagcaaagcgggccagcgtgccatggtggaagcattttctccgttcctgggcccggaagttcaatgcaacgcaattgctccgggtccggtcgacggtgatcgtctgtctggtaccggcggtaaaccgggcctgtttcagcgtcgcgcgaaactgatcctggaaaacaaacgcctgaatgctgtgtatagtgcggttatccatgccattcgtgaaggcggtgatgcagctaaaattctgacccgtctgagtcgcaattcgaccagcacgctgtcccacgatgcagaagcaccggaagaactgcgtaaactggcactggattttgctagccagggcgacggtctgtgtacctgggatcaatacctgctgacggacgcaatggctcagcgtctgctggtgcgtctgcaactgggcggttttctgctgggttcaaacgaatgggcctcgctgagttcctcagaacagacctggctgaaactgtcaccgccggacgataaaccgttcctgccggcggcccaagttgataaagtcgcgaatggcgtcggtaaaggcgtgatttcgcagctgcatctgggtgcaatgccgaccgaagccgaagttgcgcaagccacggtctttttcctggcagatcgcgctgtgtcaggtgaaacctttatgccgtcgggcggtctgcgtgttgaacgctcaaacaccgaacgcgaaatgttcggctcgccgaaacaggaacgtatcgataaaatgaaaggtaaaaccgtctggattatcggcgaacacctgagtgactatgtggcagctacgatcgaagaactggtgtccggttgcggcgttgcgaaagtggttctgattgccaaagataaaagcggtgaaaaagcggttcgtgaccagctgccgaatgacctgtctaaagatgcactggaagtgctgatcgctggtgatggcctggaagaagcgatggacgaagccctgggccattggggtaaaccgaccacggtgctgtcaatgccgggcgaaccgctgccggatcacctgtttgaaggcggtaacccgctgtcgaccaaagacttcgcacatatggtggaagctaatattacccgtcactatcgcgttacgcgtaaagcgtccctgtacgatggttgtcaggtcgtgctggttagcccggatgtcccgtacggttctgacggtccgggtgttgcactggctaactttgtcaaaacctctctgcatgcgttcaccgccacggtggcagttgaaaatgaacgcctggttcacgatgtcccggtgaaccagatcaatctgacgcgtcgcgtgtcgagcgaagaaccgcgtgacgcagatgaacatgctgaagaactgcgtcgctttacccgtgcagtgctgctggttggtgcaccgctgccggacgcacaggattcacgttatcgctcgaaaatttaccgcggcaccagcatgacggtg

SEQ ID NO: 896 - DNA, 2568 bp, Artificial Sequence; identical to SEQ ID NO: 868
  Description of Artificial Sequence: Synthetic polynucleotide

SEQ ID NO: 897 - DNA, 2172 bp, Artificial Sequence; identical to SEQ ID NO: 867
  Description of Artificial Sequence: Synthetic polynucleotide

SEQ ID NO: 898 - DNA, 657 bp, Escherichia coli
gtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcg

SEQ ID NO: 899 - DNA, 468 bp, Escherichia coli
atgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttc

SEQ ID NO: 900 - DNA, 1230 bp, Escherichia coli
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaaccaggttgatctggatgcggcggcaaagcgcgggatcccggtatttaacgcaccgttctcaaatacgcgctctgttgcggagctggtgattggcgaactgctgctgctattgcgcggcgtgccggaagccaatgctaaagcgcaccgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaataaactgccgctgggcaacgccactcaggtacagcatctttctgacctgctgaatatgagcgatgtggtgagtctgcatgtaccagagaatccgtccaccaaaaatatgatgggcgcgaaagaaatttcactaatgaagcccggctcgctgctgattaatgcttcgcgcggtactgtggtggatattccggcgctgtgtgatgcgctggcgagcaaacatctggcgggggcggcaatcgacgtattcccgacggaaccggcgaccaatagcgatccatttacctctccgctgtgtgaattcgacaacgtccttctgacgccacacattggcggttcgactcaggaagcgcaggagaatatcggcctggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctgaacaaaatcttcgccgagcagggcgtcaacatcgccgcgcaatatctgcaaacttccgcccagatgggttatgtggttattgatattgaagccgacgaagacgttgccgaaaaagcgctgcaggcaatgaaagctattccgggtaccattcgcgcccgtctgctgtac

SEQ ID NO: 901 - DNA, 1530 bp, Escherichia coli
atggcaattggcataccaagagaacggttaaccaatgaaacccgtgttgcagcaacgccaaaaacagtggaacagctgctgaaactgggttttaccgtcgcggtagagagcggcgcgggtcaactggcaagttttgacgataaagcgtttgtgcaagcgggcgctgaaattgtagaagggaatagcgtctggcagtcagagatcattctgaaggtcaatgcgccgttagatgatgaaattgcgttactgaatcctgggacaacgctggtgagttttatctggcctgcgcagaatccggaattaatgcaaaaacttgcggaacgtaacgtgaccgtgatggcgatggactctgtgccgcgtatctcacgcgcacaatcgctggacgcactaagctcgatggcgaacatcgccggttatcgcgccattgttgaagcggcacatgaatttgggcgcttctttaccgggcaaattactgcggccgggaaagtgccaccggcaaaagtgatggtgattggtgcgggtgttgcaggtctggccgccattggcgcagcaaacagtctcggcgcgattgtgcgtgcattcgacacccgcccggaagtgaaagaacaagttcaaagtatgggcgcggaattcctcgagctggattttaaagaggaagctggcagcggcgatggctatgccaaagtgatgtcggacgcgttcatcaaagcggaaatggaactctttgccgcccaggcaaaagaggtcgatatcattgtcaccaccgcgcttattccaggcaaaccagcgccgaagctaattacccgtgaaatggttgactccatgaaggcgggcagtgtgattgtcgacctggcagcccaaaacggcggcaactgtgaatacaccgtgccgggtgaaatcttcactacggaaaatggtgtcaaagtgattggttataccgatcttccgggccgtctgccgacgcaatcctcacagctttacggcacaaacctcgttaatctgctgaaactgttgtgcaaagagaaagacggcaatatcactgttgattttgatgatgtggtgattcgcggcgtgaccgtgatccgtgcgggcgaaattacctggccggcaccgccgattcaggtatcagctcagccgcaggcggcacaaaaagcggcaccggaagtgaaaactgaggaaaaatgtacctgctcaccgtggcgtaaatacgcgttgatggcgctggcaatcattctttttggctggatggcaagcgttgcgccgaaagaattccttgggcacttcaccgttttcgcgctggcctgcgttgtcggttattacgtggtgtggaatgtatcgcacgcgctgcatacaccgttgatgtcggtcaccaacgcgatttcagggattattgttgtcggagcactgttgcagattggccagggcggctgggttagcttccttagttttatcgcggtgcttatagccagcattaatattttcggtggcttcaccgtgactcagcgcatgctgaaaatgttccgcaaaaat

SEQ ID NO: 902 - DNA, 1386 bp, Escherichia coli
atgtctggaggattagttacagctgcatacattgttgccgcgatcctgtttatcttcagtctggccggtctttcgaaacatgaaacgtctcgccagggtaacaacttcggtatcgccgggatggcgattgcgttaatcgcaaccatttttggaccggatacgggtaatgttggctggatcttgctggcgatggtcattggtggggcaattggtatccgtctggcgaagaaagttgaaatgaccgaaatgccagaactggtggcgatcctgcatagcttcgtgggtctggcggcagtgctggttggctttaacagctatctgcatcatgacgcgggaatggcaccgattctggtcaatattcacctgacggaagtgttcctcggtatcttcatcggggcggtaacgttcacgggttcggtggtggcgttcggcaaactgtgtggcaagatttcgtctaaaccattgatgctgccaaaccgtcacaaaatgaacctggcggctctggtcgtttccttcctgctgctgattgtatttgttcgcacggacagcgtcggcctgcaagtgctggcattgctgataatgaccgcaattgcgctggtattcggctggcatttagtcgcctccatcggtggtgcagatatgccagtggtggtgtcgatgctgaactcgtactccggctgggcggctgcggctgcgggctttatgctcagcaacgacctgctgattgtgaccggtgcgctggtcggttcttcgggggctatcctttcttacattatgtgtgaggcgatgaaccgttcctttatcagcgttattgcgggtggtttcggcaccgacggctcttctactggcgatgatcaggaagtgggtgagcaccgcgaaatcaccgcagaagagacagcggaactgctgaaaaactcccattcagtgatcattactccggggtacggcatggcagtcgcgcaggcgcaatatcctgtcgctgaaattactgagaaattgcgcgctcgtggtattaatgtgcgtttcggtatccacccggtcgcggggcgtttgcctggacatatgaacgtattgctggctgaagcaaaagtaccgtatgacatcgtgctggaaatggacgagatcaatgatgactttgctgataccgataccgtactggtgattggtgctaacgatacggttaacccggcggcgcaggatgatccgaagagtccgattgctggtatgcctgtgctggaagtgtggaaagcgcagaacgtgattgtctttaaacgttcgatgaacactggctatgctggtgtgcaaaacccgctgttcttcaaggaaaacacccacatgctgtttggtgacgccaaagccagcgtggatgcaatcctgaaagctctg

SEQ ID NO: 903 - DNA, 1401 bp, Escherichia coli
atggccccacattcctacgattacgatgccatagtaataggttccggccccggcggcgaaggcgctgcaatgggcctggttaagcaaggtgcgcgcgtcgcagttatcgagcgttatcaaaatgttggcggcggttgcacccactggggcaccatcccgtcgaaagctctccgtcacgccgtcagccgcattatagaattcaatcaaaacccactttacagcgaccattcccgactgctccgctcttcttttgccgatatccttaaccatgccgataacgtgattaatcaacaaacgcgcatgcgtcagggattttacgaacgtaatcactgtgaaatattgcagggaaacgctcgctttgttgacgagcatacgttggcgctggattgcccggacggcagcgttgaaacactaaccgctgaaaaatttgttattgcctgcggctctcgtccatatcatccaacagatgttgatttcacccatccacgcatttacgacagcgactcaattctcagcatgcaccacgaaccgcgccatgtacttatctatggtgctggagtgatcggctgtgaatatgcgtcgatcttccgcggtatggatgtaaaagtggatctgatcaacacccgcgatcgcctgctggcatttctcgatcaagagatgtcagattctctctcctatcacttctggaacagtggcgtagtgattcgtcacaacgaagagtacgagaagatcgaaggctgtgacgatggtgtgatcatgcatctgaagtcgggtaaaaaactgaaagctgactgcctgctctatgccaacggtcgcaccggtaataccgattcgctggcgttacagaacattgggctagaaactgacagccgcggacagctgaaggtcaacagcatgtatcagaccgcacagccacacgtttacgcggtgggcgacgtgattggttatccgagcctggcgtcggcggcctatgaccaggggcgcattgccgcgcaggcgctggtaaaaggcgaagccaccgcacatctgattgaagatatccctaccggtatttacaccatcccggaaatcagctctgtgggcaaaaccgaacagcagctgaccgcaatgaaagtgccatatgaagtgggccgcgcccagtttaaacatctggcacgcgcacaaatcgtcggcatgaacgtgggcacgctgaaaattttgttccatcgggaaacaaaagagattctgggtattcactgctttggcgagcgcgctgccgaaattattcatatcggtcaggcgattatggaacagaaaggtggcggcaacactattgagtacttcgtcaacaccacctttaactacccgacgatggcggaagcctatcgggtagctgcgttaaacggtttaaaccgcctgttt

SEQ ID NO: 904 - DNA, 1242 bp, Escherichia coli
atgggatctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatc

SEQ ID NO: 905 - DNA, 7999 bp, Artificial Sequence; identical to SEQ ID NO: 871
  Description of Artificial Sequence: Synthetic polynucleotide

What is claimed is:

1. A method for producing an acrylic acid-based consumer product, said method comprising:
   i) combining a carbon source, a microorganism, and cell culture to produce 3-hydroxypropionic acid, wherein:
      a) said cell culture comprises an inhibitor of fatty acid synthase or said microorganism is genetically modified to comprise a deletion of an enzyme, or a substitution of an enzyme with a mutated version of said enzyme, wherein said enzyme selected from the group consisting of: malonyl-CoA-ACP transacylase, beta-ketoacyl-ACP synthase I, beta-ketoacyl-acyl carrier protein synthase II, and enoyl-ACP reductase, thereby providing for reduced conversion of malonyl-CoA to fatty acids; and
      b) wherein said microorganism is genetically modified for increased enzymatic activity in the microorganism's malonyl-CoA reductase (mcr) pathway by introduction of a heterologous nucleic acid sequence coding for a polypeptide having mono- or bi-functional malonyl-CoA reductase activity;
   ii) converting said 3-hydroxypropionic acid to acrylic acid; and
   iii) processing said acrylic acid into a consumer product.

2. The method of claim 1, wherein said carbon source has a ratio of carbon-14 to carbon-12 of about $1.0 \times 10^{-14}$ or greater.

3. The method of claim 1, wherein said carbon source is predominantly a sugar selected from the group consisting of: glucose, sucrose, fructose, dextrose, and lactose, or any combination thereof.

4. The method of claim 1, wherein said carbon source is less than 50% glycerol.

5. The method of claim 1, wherein said cell culture comprises an inhibitor of fatty acid synthase.

6. The method of claim 5, wherein said inhibitor of a fatty acid synthase is selected from the group consisting of: thiolactomycin, triclosan, cerulenin, thienodiazaborine, isoniazid, and analogs thereof, or any combination thereof.

7. The method of claim 1, wherein said microorganism is genetically modified for reduced enzymatic activity in the microorganism's fatty acid synthase pathway providing for reduced conversion of malonyl-CoA to fatty acids.

8. The method of claim 7, wherein the reduced enzymatic activity is a reduction in enzymatic activity in an enzyme selected from the group consisting of beta-ketoacyl-ACP reductase, 3-hydroxyacyl-CoA dehydratase, enoyl-ACP reductase, thioesterase, and any combination thereof.

9. The method of claim 7, wherein said microorganism is genetically modified via introduction of a heterologous nucleic acid sequence having an inducible promoter operably linked to a sequence coding for an enzyme in the fatty acid synthase pathway or homolog thereof, or a heterologous nucleic acid sequence coding for an enzyme in the fatty acid synthase pathway or homolog thereof with reduced activity.

10. The method of claim 1, wherein said mutated version of said enzyme is temperature-sensitive.

11. The method of claim 1, wherein said microorganism is genetically modified for increased enzymatic activity in the microorganism's malonyl-CoA reductase (mcr) pathway by introduction of a heterologous nucleic acid sequence coding for a polypeptide having mono-functional malonyl-CoA reductase activity.

12. The method of claim 11, wherein said polypeptide having mono-functional malonyl-CoA reductase activity is NADPH-independent.

13. The method of claim 1, wherein said increase in enzymatic activity in the malonyl-CoA reductase (mcr) pathway occurs by introduction of a heterologous nucleic acid sequence coding for a polypeptide having bi-functional malonyl-CoA reductase enzymatic activity.

14. The method of claim 11, wherein said heterologous nucleic acid sequence is selected from a sequence encoding a polypeptide having at least 90% identity with a sequence selected from SEQ ID NOs. 783-791.

15. The method of claim 1, wherein said 3-hydroxypropionic acid is produced at a specific productivity of greater than 0.05 grams per gram of microorganism cell on a dry weight basis per hour or at a volumetric productivity of greater than 0.5 grams per liter per hour.

16. The method of claim 1, wherein said microorganism is further modified for a trait selected from the group consisting of: increased tolerance to 3-hydroxypropionic acid, increased enzymatic activity in the microorganism's NADPH-dependent transhydrogenase pathway, increased intracellular bicarbonate levels, increased enzymatic activity in the microorganism's acetyl-CoA carboxylase pathway, and combinations thereof.

17. The method of claim 16, wherein said genetically modified microorganism is modified for increased tolerance to 3-hydroxypropionic acid.

18. The method of claim 17, wherein said increased tolerance to 3-hydroxypropionic acid occurs in one or more components of the 3-HP toleragenic complex (3HPTGC), or wherein said increased tolerance to 3-hydroxypropionic acid results from providing at least one genetic modification of each of Group A and Group B of the 3HPTGC.

19. The method of claim 18, wherein said one or more components are selected from the group consisting of: CynS, CynT, AroG, SpeD, SpeE, SpeF, ThrA, Asd, CysM, IroK, IlvA, and homologs thereof, or any combination thereof.

20. The method of claim 18, wherein said genetic modification is a disruption of one or more 3HPTGC repressor genes.

21. The method of claim 20, wherein said one or more 3HPTGC repressor genes are selected from the group consisting of: tyrR, trpR, metJ, purR, lysR, nrdR, and homologs thereof, or any combination thereof.

22. The method of claim 16, wherein said microorganism is further modified for increased enzymatic activity in the microorganism's NADPH-dependent transhydrogenase pathway by introduction of a heterologous nucleic acid sequence coding for a polypeptide having at least 90% identity with one or more sequences selected from the group consisting of SEQ ID NOs. 780 and 782.

23. The method of claim 16, wherein said microorganism is further modified for increased intracellular bicarbonate levels by introduction of a heterologous nucleic acid sequence coding for a polypeptide having cyanase or carbonic anhydrase activity.

24. The method of claim 23, wherein said heterologous nucleic acid sequence is a sequence having at least 90% homology to SEQ ID NO. 337.

25. The method of claim 16, wherein said microorganism is modified for increased enzymatic activity in the microorganism's acetyl-CoA carboxylase pathway by introduction of a heterologous nucleic acid sequence coding for a polypeptide having at least 90% identity with one or more sequences selected from the group consisting of: SEQ ID NOs. 772, 774, 776 and 778.

26. The method of claim 1, wherein said microorganism is further modified to decrease activity of lactate dehydrogenase, phosphate acetyltransferase, pyruvate oxidase, pyruvate-formate lyase, or any combination thereof.

27. The method of claim 1, wherein following (i), said method further comprises extracting 3-hydroxypropionic acid from said cell culture in the presence of a tertiary amine.

28. The method of claim 27, wherein said 3-hydroxypropionic acid is produced at a specific productivity of greater than 0.05 grams per gram of microorganism cell on a dry weight basis per hour or at a volumetric productivity of greater than 0.50 grams per liter per hour.

29. The method of claim 1, wherein said consumer product is selected from the group consisting of diapers, carpet, paint, adhesives, and acrylic glass.

30. The method of claim 29, wherein said consumer product is diapers.

31. The method of claim 1, wherein said heterologous nucleic acid sequence coding for a polypeptide having mono- or bi-functional malonyl-CoA reductase activity is from a species selected from the group consisting of: *Chloroflexus aurantiacus*, *Chloroflexus aggregans*, *Roseiflexus castenholzii*, *Roseiflexus* sp., *Erythrobacter* sp., gamma proteobacterium, marine gamma proteobacterium, *Sulfolobus tokodaii*, and *Metallosphaera sedula*.

\* \* \* \* \*

UNITED STATES PATENT AND TRADEMARK OFFICE
CERTIFICATE OF CORRECTION

| | |
|---|---|
| PATENT NO. | : 8,883,464 B2 |
| APPLICATION NO. | : 13/498468 |
| DATED | : November 11, 2014 |
| INVENTOR(S) | : Michael D. Lynch et al. |

It is certified that error appears in the above-identified patent and that said Letters Patent is hereby corrected as shown below:

In the Specification

In column 1, line 17, insert the following government grant information

--STATEMENT AS TO FEDERALLY SPONSORED RESEARCH

This invention was made with government support under Contract No. DE-AR0000088 awarded by the Department of Energy. The Government has certain rights in this invention.--

Signed and Sealed this
Thirtieth Day of June, 2015

Michelle K. Lee
*Director of the United States Patent and Trademark Office*